United States Patent 9,328,353 (ISOLATED POLYNUCLEOTIDES AND POLYPEPTIDES FOR INCREASING PLANT YIELD AND/OR AGRICULTURAL CHARACTERISTICS) - sequence listing, part 3

SEQ ID NO: 4441 - protein, 175 aa, Hordeum vulgare
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYNGRYWTMWKLPMFGCTDATQVLNEVEEVKKEYPDAYVRIIGFDNMRQVQCVSFIAFKPPGCQESGKA

SEQ ID NO: 4442 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4443 - protein, 174 aa, Festuca arundinacea
MAPAVMASSATTVAPFQGLKSTAGLPVSRRSAASLGSVSNGGRIRCMQVWPIEGIKKFETLSYLPPLSAEALLKQIDFLIRSKWVPCLEFSKVGFIFREHGSTPGYYDGRYWTMWKLPMFGCTDATQVLKEVEEVKKEYPDAYVRIIGFDNIRQVQCVSFIAFKPPGCEESGKA

SEQ ID NO: 4444 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGRYWTMWKLPMFGCTDATQVINEVEEVKKEYPDAYVRIIGFDNMRQVQCVSFIAFKPPGCKESGKA

SEQ ID NO: 4445 - protein, 176 aa, Leymus cinereus x Leymus triticoides
  misc_feature (35)..(35): Xaa can be any naturally occurring amino acid
MAPTVMSSAATAVAPFQGLKSTAGLPVSRRSGSAXGLGSVSNGGRIRCMQVWPIEGIKKFETLSYLPPLTTEALLKQVDYLIRSKWVPCLEFSKVGFIFREHNASPGYYDGRYWTMWKLPMFGCTDATQVLKEVEEVKKEYPDAYVRIIGFDNMRQVQCVSFIAFKPPGCEESGKA

SEQ ID NO: 4446 - protein, 175 aa, Leymus cinereus x Leymus triticoides
MAPAVMASSATTVAPFQGLKSTAGLPLSRRSGSAGLSSVSNGGRIRCMQVWPIEGIKKFETLSYLPPLSTEALLKQIDYLIRSKWVPCLEFSKVGFVFREHNSSPGYYDGRYWTMWKLPMFGCTDATQVLKELEEVKKEYPDAYVRIIGFDNYRQVQCISFIAYKPPGCEESGKA

SEQ ID NO: 4447 - protein, 174 aa, Festuca arundinacea
MAPTVMASSATTVAPFQGLKSTAGLPVSRRSAASLGSVSNGGRIRCMQVWPIEGIKKFETLSYLPPLSAEALLKQIDFLIRSKWVPCLEFSKVGFIFREHGSTPGYYDGRYWTMWKLPMFGCTDATQVLKEVEEVKKEYPDAYVRIIGFDNIRQVQCVSFIAFKPPGCEESGKA

SEQ ID NO: 4448 - protein, 138 aa, Setaria italica
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVQEGVP

SEQ ID NO: 4449 - protein, 174 aa, Lolium multiflorum
MAPAVMASSATTVAPFQGLKSTAGLPVSRRSAASLGSVSNGGRIRCMQVWPIEGIKKFETLSYLPPLSPEALLKQIDFLIRSKWVPCLEFSKVGFIFREFGSTPGYYDGRYWTMWKLPMFGCTDAAQVLKEVEEVKKEYPDAYVRIIGFDNIRQVQCVSFIAFKPPGCEESGKA

SEQ ID NO: 4450 - protein, 174 aa, Unknown
  Sequence found in Organisms: Festuca arundinacea, Lolium multiflorum
MAPAVMASSATTVAPFQGLKSTAGLPVSRRSAASLGSVSNGGRIRCMQVWPIEGIKKFETLSYLPPLSAEALLKQIDFLIRSKWVPCLEFSKVGFIFREFGSTPGYYDGRYWTMWKLPMFGCTDATQVLKEVDEVKKEYPDAYVRIIGFDNIRQVQCVSFIAFKPPGCEESGKA

SEQ ID NO: 4451 - protein, 174 aa, Lolium multiflorum
MAPTVMASSATTVAPFQGLKSTAGLPVSRRSAASLGSVSNGGRIRCMQVWPIEGIKKFETLSYLPPLSPEALLKQIDFLIRSKWVPCLEFSKVGFIFREFGSTPGYYDGRYWTMWKLPMFGCTDATQVLKEVEEVKKEYPDAYVRIIGFDNIRQVQCVSFIAFKPPGCEESGKA

SEQ ID NO: 4452 - protein, 174 aa, Avena sativa
MAPAVMASSATTVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4453 - protein, 128 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDARR

SEQ ID NO: 4454 - protein, 176 aa, Leymus cinereus x Leymus triticoides
MAPTVMSSAATAVAPFQGLKSTAGLPVSRRSGSAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNLRQVQCVSFIAFKPPGCEESGKA

SEQ ID NO: 4455 - protein, 174 aa, Festuca arundinacea
MAPAVMASSATTVAPFQGLKSTAGLPVSRRSAASLGSVSNGGRIRCMQVWPIEGIKKFETLSYLPPLSAEDLLKQIDFLIRSKWVPCLEFSKVGFIFREHGSTPGYYDGRYWTMWKLPMFGCTDAAQVLKEVEEVKKEYPDAYVRIIGFDNIRQVQCVSFIAFKPPGCEESGKA

SEQ ID NO: 4456 - protein, 174 aa, Lolium multiflorum
MAPTVMASSATTVAPFQGLKSTAGLPVSRRSAASLGSVSNGGRIRCMQVWPIEGIKKFETLSYLPPLSAEALLKQIDFLIRSKWVPCLEFSKVGFIFREHGSTPGYYDGRYWTMWKLPMFGCTDAAQVLKEVEEVKKEYPDAYVRIIGFDNIRQVQCVSFIAFKPPGCEESGKA

SEQ ID NO: 4457 - protein, 73 aa, Hordeum vulgare
MAPTVMASSATSVAPFQGLKSTAGLPVSRRSNGASSAASERWKDQVHAGVAHRGHQEVRDPVLLATTQHGGPP

SEQ ID NO: 4458 - protein, 176 aa, Pseudoroegneria spicata
MAPTVMSSAATAVAPFQGLKSTAGLPVSRRSGSAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4459 - protein, 184 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYLTRMSASSDSQHAPGPVGQFHPLQAPGLRGVRQGLNSSLTTGHK

SEQ ID NO: 4460 - protein, 174 aa, Hordeum vulgare
MAPAVMASSATTVAPFQGLKSTAGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRHVRCVSFCALSHRGARSPARP

SEQ ID NO: 4461 - protein, 174 aa, Avena sativa
MAPTVMASSATTVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4462 - protein, 174 aa, Avena sativa
MAPAVMASSATIVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4463 - protein, 174 aa, Avena sativa
MAPAVMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4464 - protein, 174 aa, Festuca arundinacea
  misc_feature (35)..(35): Xaa can be any naturally occurring amino acid
MAPTVMASSATTVAPFQGLKSTAGLPVSRRSAASXGSVSNGGRIRCMQVWPIEGIKKFETLSYLPPLSAEALLKQIDFLIRSKWVPCLEFSKVGFIFREHGSTPGYYDGRYWTMWKLPMFGCTDAAQVLKEVEEVKKEYPDAYVRIIGFDNVRQVQCVSFIAFKPPGCEESGKA

SEQ ID NO: 4465 - protein, 175 aa, Brachypodium distachyon
MAPTVMASSATSVAPFQGLKSTAGLPVASRRSSNSLGSVSNGGRIRCMQVWPIEGIKKFETLSYLPPLSVESLLKQIEYLIRSKWVPCLEFSKVGFVFREHNSSPGYYDGRYWTMWKLPMFGCTDATQVLKELEEVKKEYPDAYVRIIGFDNTRQVQCISFIAFKPPGCEESGKA

SEQ ID NO: 4466 - protein, 174 aa, Brachypodium distachyon
MAPTVMASSATSVAPFQGLKSTAGLPLSRRSSNSLGRVSNGGRISCMQVWPIEGIKKFETLSYLPPLSVESLLKQIEYLIRSKWVPCLEFSKVGFVFREHNSSPGYYDGRYWTMWKLPMFGCTDATQVLKELEEVKKEYPDAYVRIIGFDNTRQVQCISFIAFKPPGCEESGKA

SEQ ID NO: 4467 - protein, 73 aa, Hordeum vulgare
MAPTVMASSATSVAPFQGLKSTAGLPVSRRSNGASSAASQRWKDQVHAGVAHRGHQEVRDPVLLATTQHGGPP

SEQ ID NO: 4468 - protein, 52 aa, Avena sativa
MAPTVMASSATTVAPFQGLKSTAGLPVQPSQLRKPRQRQQRWKNQMHAGVAD

SEQ ID NO: 4469 - protein, 140 aa, Avena sativa
MAPAVMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWEAAHVRLHRRLTGDQGGGGGQEGVP

SEQ ID NO: 4470 - protein, 175 aa, Hordeum vulgare
MAPTVMSSAATAVAPFQGLKSTAGLPVSRLSGNAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCEESGK

SEQ ID NO: 4471 - protein, 175 aa, Leymus cinereus x Leymus triticoides
  misc_feature (14)..(14): Xaa can be any naturally occurring amino acid
  misc_feature (27)..(27): Xaa can be any naturally occurring amino acid
  misc_feature (35)..(35): Xaa can be any naturally occurring amino acid
MAPTVMASSATSVXPFQGLKSTAGLPXSRRSSSAXLSSVSNGGRIRCMQVWPIEGIKKFETLSYLPPLSTEALLKQIDYLIRSKWVPCLEFSKVGFVFREHNSSPGYYDGRYWTMWKLPMFGCTDATQVLKELEEVKKEYPDAYVRIIGFDNYRQVQCISFIAYKPPGCEESGKA

SEQ ID NO: 4472 - protein, 174 aa, Lolium multiflorum
MAPTVMASSATTVAPFQGLKSTAGLPVSRRSAASLSSVSNGGRIRCMQVWPIEGIKKFETLSYLPPLSPEALLKQIDFLIRSKWVPCLEFSKVGFIFREFGSTPGYYDGRYWTMWKLPMFGCTDAAQVLKEVEEVKKEYPDAYVRIIGFDNIRQVQCVSFIAFKPPGCEESGKA

SEQ ID NO: 4473 - protein, 174 aa, Avena sativa
MAPAVMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4474 - protein, 174 aa, Avena sativa
MAPAVMASSANSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4475 - protein, 174 aa, Avena sativa
MAPAVMASSATSVAPFQGLKSTAGLPVSRRGNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4476 - protein, 174 aa, Avena sativa
MAPTVMASSATTVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGWEESGKA

SEQ ID NO: 4477 - protein, 174 aa, Avena sativa
MAPTVMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4478 - protein, 174 aa, Avena sativa
MAPTVMASSATTVAPFQGLKSTAGLPVSRRSSGVLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4479 - protein, 174 aa, Avena sativa
MAPAVMASSATSVAPFQGLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4480 - protein, 174 aa, Festuca arundinacea
MAPAVMASSATSVAPFQGLKSTAGLPVSRRSNAGLGRVSNGGRIRCMQVWPIEGIKKFETLSYLPPLSTEELLKQIDFLIRSKWVPCLEFSKVGFVFREFGSTPGYYDGRYWTMWKLPMFGCTDAAQVAKEVEEVKKEYPDAYVRIIGFDNVRQVQCVSFIAYKPPGCEESGKA

SEQ ID NO: 4481 - protein, 164 aa, Secale cereale
  misc_feature (7)..(7): Xaa can be any naturally occurring amino acid
  misc_feature (32)..(32): Xaa can be any naturally occurring amino acid
  misc_feature (164)..(164): Xaa can be any naturally occurring amino acid
MASSATXVAPFQGLKSTAGLPVSRRSSGSLGXVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCX

SEQ ID NO: 4482 - protein, 179 aa, Gossypium hirsutum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSLMGFKPPGCEESGKAKTAH

SEQ ID NO: 4483 - protein, 176 aa, Hordeum vulgare
MAPTVMSSAATAVAPFQGLKSTAGLPVSRLSGNAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVHCVSFIAFKPPGCEKSGKA

SEQ ID NO: 4484 - protein, 98 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLDSASWVHLP

SEQ ID NO: 4485 - protein, 181 aa, Avena sativa
AVYLPPWPRRDGIVGHHGRALPGLKSTAGLPVSRRSNGSLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKAKA

SEQ ID NO: 4486 - protein, 52 aa, Avena sativa
MAPTVMASSATSVAPFQGLKSTAGLPVQPPQQCRPRQRQQRRKDQVHAGVAD

SEQ ID NO: 4487 - protein, 128 aa, Avena sativa
MQVWPIEGIKKFETLSYLPPLSEEALLKQIDFLIRSKWVPCLEFSKVGFIFREHGSTPGYYDGRYWQMWKLPMFGCTDASQVIKEVEEVKKEYPDAYVRIIGFDNIRQVQCVSFIAFKPPGCEESGKA

SEQ ID NO: 4488 - protein, 172 aa, Hordeum vulgare
MAPAVMASSATTVAPFQGLKSTAGLPVSRRSSASLGRVSNGGRIRGVQVWPIEGIKKFKTLSYLPPLTTEALLKQVDYLIRSKWVPCLEFNKGGLVFREHNSSPGYYDGRYWTMWKLPMFGCTDATQVLNEVEEGNKEYPDAYVRIIGFYNLRHVHCVIFIAFTPPGREESR

SEQ ID NO: 4489 - protein, 174 aa, Avena sativa
MAPAVMASSATSVAPFQGLKSTAGLPVSRRGNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4490 - protein, 174 aa, Avena sativa
MAPTVTASSATSVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4491 - protein, 174 aa, Avena sativa
MAPTVMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4492 - protein, 174 aa, Avena sativa
MAPAVMASSATSVAPFQGLKSTAGLPVSRRSASSLGNVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESGKA

SEQ ID NO: 4493 - protein, 174 aa, Festuca arundinacea
MAPAVMASSATSVAPFLGLKSTAGLPVSRRSNAGLGSVSNGGRIRCMQVWPIEGIKKFETLSYLPPLSTEELLKQIDFLIRSKWVPCLEFSKVGFVFREFGSTPGYYDGRYWTMWKLPMFGCTDATQVAKEVEEVKKEYPDAYVRIIGFDNIRQVQCVSFIAYKPPGCEESGKA

SEQ ID NO: 4494 - protein, 176 aa, Avena sativa
MAPAVMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKAKA

SEQ ID NO: 4495 - protein, 173 aa, Avena sativa
MAPVVASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4496 - protein, 175 aa, Avena sativa
MAPTVMASSATSVAPFQGLKSTAGLPVSRRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4497 - protein, 174 aa, Avena sativa
MAPTVMASSATSVAPFQGLKSTAGLPISRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4498 - protein, 174 aa, Avena sativa
MAPTVTASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4499 - protein, 174 aa, Avena sativa
MAPTVMASSATSVAPFQGLKSTAGLPVNRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4500 - protein, 174 aa, Avena sativa
MAPTVTASSATSVAPFQGLKSTAGLPVSRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4501 - protein, 170 aa, Avena sativa
VMASSATTVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4502 - protein, 175 aa, Festuca arundinacea
MAPTVMSSAATAVAPFQGLKSTAGLPVSRRSSSSGLGSVSNGGRIRCMQVWPIEGIKKFETLSYLPPLSTEALLKQIDFLIRSKWVPCLEFSKVGFVFREHGSTPGYYDGRYWTMWKLPMFGCTDAAQVVKELEEVKKEYPDAYVRIIGFDNIRQVQCVSFIAFKPPGCEESGKA

SEQ ID NO: 4503 - protein, 174 aa, Lolium multiflorum
MAPAVMASSATSVAPFQGLKSTAGLPVSRRSNARLGSVSNGGRIRCMQVWPIEGIKKFETLSYLPPLSTEDLLKQIDFLIRSKWVPCLEFSKVGFVFREFGSTPGYYDGRYWTMWKLPMFGCTDAAQVAKEVEEVKKEYPDAYIRIIGFDNIRQVQCVSFIAYKPPGCEESGKA

SEQ ID NO: 4504 - protein, 52 aa, Avena sativa
MAPTVTASSATSVAPFQGLKSTAGLPVQPSQQCRPWQRQQRWKNQMHAGVAY

SEQ ID NO: 4505 - protein, 72 aa, Avena sativa
MAPVVASSATSVAPFQGLKSTAGLPVSRRSNAGLGSVSNGGRIRCMQVWPIEGIKKFETLSLPAHHSQRRPS

SEQ ID NO: 4506 - protein, 53 aa, Avena sativa
MAPTVMAPSATSVAPFQGLKSTAGLPVQPPPQQCRPRQRQQRRKDQVHAGVAD

SEQ ID NO: 4507 - protein, 166 aa, Gossypium hirsutum
MAPAVMASSATTVAPFQGLKSTAGLPVSRRSSASLGSVSNGGRIRCMQVWPIEGIKKFETLSYLPPLTTEALLKHVDYLIRSKWVPCLDFSKVGFAFREHNSSPGYYDGRYWTMWKLPMFGCTDATQVLNEVEEVKNEYPDAHVAIIGFDNLRQVQCINFITIRPP

SEQ ID NO: 4508 - protein, 169 aa, Avena sativa
MASSATTVAPFQGLKSTAGLPVSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4509 - protein, 173 aa, Avena sativa
MAPVVASSATSVAPFQGFKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4510 - protein, 174 aa, Avena sativa
MAPTMTASSATSVAPFQGLKSTAGLPVSRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4511 - protein, 128 aa, Avena sativa
MQVWPIEGIKKFETLSYLPPLSEEALLKQIDFLIRSKWVPCLEFSKVGFIFREHGSTPGYYDGRYWAMWKLPMFGCTDASQVIKEVEEVKKEYPDAYVRIIGFDNIRQVQCVSFIAFKPPGCEESGKA

SEQ ID NO: 4512 - protein, 207 aa, Avena sativa
MAPTVTASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEEVRKGLSHELGIYNRCYMKCIVQILYEGFYMFAGDFVW

SEQ ID NO: 4513 - protein, 161 aa, Triticum aestivum
PFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4514 - protein, 175 aa, Brachypodium distachyon
MAPTVMSSAATAVAPFQGLKSTAGLPIGRRSASAGLGSVSNGGRIRCMQVWPIEGIKKFETLSYLPPLTVESLLKQIEYLIRSKWVPCLEFSKVGFVFREHGNSPGYYDGRYWTMWKLPMFGCTDATQVLKELEEVKKEYPDAYVRIIGFDNTRQVQCISFIAFKPPGCEESGKA

SEQ ID NO: 4515 - protein, 175 aa, Avena sativa
MAPVVASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKAKA

SEQ ID NO: 4516 - protein, 143 aa, Avena sativa
MPASAASATAEGSGACRCGRLEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4517 - protein, 195 aa, Avena sativa
MAPTVTASSATSVAPFQGLKSTAGLPVSRRSNAGLGSVSNGGRIRCMQVWPIEGIKKFETLSYLPPLSEEALLKQIDFLIRSKWVPCLETSKVGFIFREHGSTPDTTMAGTGQCGSCPCSAAPTPHRSSRRWRRSRRSTLTPMSASSASTTSVKCSASASSPSSHRVARSPARPKPRAGNNRCSMKCLVKICRQF

SEQ ID NO: 4518 - protein, 170 aa, Avena sativa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4519 - protein, 169 aa, Avena sativa
MASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4520 - protein, 174 aa, Avena sativa
MAPTMTASSATSVAPFQGLKSTAGLPVSCRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4521 - protein, 172 aa, Avena sativa
PTVTASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4522 - protein, 174 aa, Hordeum vulgare
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIASSHQAARSPAR

SEQ ID NO: 4523 - protein, 175 aa, Triticum aestivum
MAPTVMGSSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVCIIGFDHTRQVQCVRFIALKKPPPPPSGKA

SEQ ID NO: 4524 - protein, 175 aa, Triticum aestivum
MPPAVMASSATTVAPFQGLKSTAGFPVSRRSGSAGLRSVSNGGRIRSMQVCPIEGIKKFETLSYFPPLSTEALLNQVDYLIRSKWVPSLEFTKVGFVFREHNSSPGYYAGRYWTMWKLPMFGCTDATQVLNEVEEVKKEYPDAYVRVIGFDNMRQVQCVSSIPFRPPGWEESAKP

SEQ ID NO: 4525 - protein, 170 aa, Avena sativa
VMASSATSVAPFQGLKSTAGLPVNRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4526 - protein, 170 aa, Avena sativa
  misc_feature (64)..(64): Xaa can be any naturally occurring amino acid
VMASSATSVAPFQGLKSTAGLPISRRSNAGLGSVSNGGRIRCMQVWPIEGIKKFETLSYLPPLXEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4527 - protein, 174 aa, Triticum aestivum
MAPAVMASTATTVAPFQGLKSTVSLAVSRRSSGSLGRVSNGGRIRCVQVWPIEGIKNFETLSYLPPLSTEALLEQVDYLIRSRWVPCLKFSKVGFVFREHNSSPGYYNGRYWTMWKLPMSGCTDTTQVLNKVEEVKKDYPDAYVRVIGFNKLPQVQCVSFIAFRPTGCEESGKA

SEQ ID NO: 4528 - protein, 129 aa, Setaria italica
ATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVQEGVP

SEQ ID NO: 4529 - protein, 95 aa, Triticum aestivum
MWKLSMFGCTDATHVLNEVEEVKKEYPDAYVRVIGFDNMRQVQCVSFICLQATRIARNPARSKVQVEVTDIHVMSVTSVGGSAFSVLLLVLLIYM

SEQ ID NO: 4530 - protein, 58 aa, Triticum aestivum
MASSVTTVVPFQGLKSTAGLPVRRLSGSASLSSVSNGGRIRCMQVWPIEGIKRFDILS

SEQ ID NO: 4531 - protein, 156 aa, Setaria italica
LKSTASLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4532 - protein, 171 aa, Avena sativa
TVTASSATSVAPFQGLKSTAGLPVSRRSNAGLGNVSNGGRIRCMQVWPIEGIKKFETLSYLPPLSEEALLKQIDFLIRSKWVPCLEPSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4533 - protein, 169 aa, Avena sativa
MASSANSVAPFPGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4534 - protein, 169 aa, Avena sativa
TASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4535 - protein, 72 aa, Avena sativa
MAPAVMASSATTVAPFQGLKSTAGLPVSRRSSGSLGSVSNGGRIRCMQVWPIEGIKKFETLLTCHHSQRRPS

SEQ ID NO: 4536 - protein, 176 aa, Brachypodium distachyon
MAPTVMASTATSVAPFQGLKSTAGLPVSRRNRSAAGLGSVSNGGRIRCMQVWPIEGIKKFETLSYLPPLSVEALLKQIEYLIRSKWVPCLEFSKVGFVFREHARSPGYYDGRYWTMWKLPMFGCTDATQVLKELEEAKKEYPDAFIRIIGFDNVRQVQCISFIAYKPPGCQESGKA

SEQ ID NO: 4537 - protein, 162 aa, Hordeum vulgare
MAPTVMASSATSVAPFQGLKSTAGLPVSRRSNGASLGSVSNGGRIRCMQVWPIEGIKKFKTLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQSVSFI

SEQ ID NO: 4538 - protein, 196 aa, Hordeum vulgare
MAPTVMASSATSVAPFQGLKSTAGLPVSRRSNGASLGSVSNRGRGGGMQVWPIEGIKKFETLSYLPPLSTEALLKQGDYLIRSKWVPCLEFSKGGVIFREHNASPGYYHGRDWTMWKLPMFGCTDAHKCSTRWRRARRSTLTRMSASSDSTTCVRGSASASSPSSHQAARSPARHKQLTDDGPHIKCHCSFVNSDI

SEQ ID NO: 4539 - protein, 165 aa, Avena sativa
ATSVAPFQGLKSTAGLPVSRRSASSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4540 - protein, 182 aa, Avena sativa
PAYCSPIPWLPPVMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4541 - protein, 168 aa, Secale cereale
  misc_feature (162)..(162): Xaa can be any naturally occurring amino acid
GSHRRRSLPGLKSTAGLPVSRRSSSAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGXEESGKA

SEQ ID NO: 4542 - protein, 158 aa, Hordeum vulgare
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQC

SEQ ID NO: 4543 - protein, 153 aa, Setaria italica
AGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4544 - protein, 175 aa, Unknown
  Sequence found in Organisms: Oryza sativa, Triticum aestivum
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4545 - protein, 175 aa, Oryza sativa
MAPSVMASSATSVAPFQGLKSTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4546 - protein, 175 aa, Avena sativa
MAPAVMASSANSVAPFQGLKSTAGLPVSRRSNAGLGSVSNGGRIRCMQVWPIEGIKKFETLSYLPPLSEEALLKQIDFFDPLQVGSLASSSAKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4547 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4548 - protein, 175 aa, Oryza sativa
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4549 - protein, 163 aa, Avena sativa
PSAPFQGLKSTAGLPVSCRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4550 - protein, 160 aa, Avena sativa
PFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4551 - protein, 89 aa, Triticum aestivum
MAPTVMASWATSIAPFQGLKSTTGLPVTRRSKGDSLGRVSHGGRIRCMQVWPIEGIREVRDPVIPATAQHGGPPQAGRLPDPLQMGALP

SEQ ID NO: 4552 - protein, 173 aa, Avena sativa
PSWLRRPPRSRPSTGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKAKA

SEQ ID NO: 4553 - protein, 157 aa, Avena sativa
GLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4554 - protein, 185 aa, Avena sativa
MAPAVMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPTRLARSLARPKPRAGNKCLF

SEQ ID NO: 4555 - protein, 157 aa, Avena sativa
GLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4556 - protein, 170 aa, Eragrostis curvula
MAPTVMASSATSVAPFQGLKSTAGLPLSRRAGSASFGRVSNGGRIRCMQVWPVENNKKFETLSYLPPLTTEDLLKQVEYLLRSNWIPCLEFSNVGFVFRENSRSPGYYDGRYWTMWKLPMFGCTDATQVLKELEEVKADYPNSFVRIIGFDNVRQVQCISFIAYKPPGSE

SEQ ID NO: 4557 - protein, 170 aa, Eragrostis curvula
MAPTVMASSATSVAPFQGLKSTAGLPLSRRSGNASFGRVSNGGRIRCMQVWPVENNKKFETLSYLPPLTTEDLLKQVEYLLRSNWVPCLEFSSVGFVFRENSQSPGYYDGRYWTMWKLPMFGCTDATQVLKELEEVKAAYPNSFVRLIGFDNVRQVQCISFIAYKPPGRE

SEQ ID NO: 4558 - protein, 93 aa, Triticum aestivum
MAASVACAFFFDAEPVGEPGMPALDACALCAKPLARDSDVFMYRGDTPYCSKECRHEQMHLDAVSARQAARRLQRFSSGAESGRARQGVSVSS

SEQ ID NO: 4559 - protein, 93 aa, Triticum aestivum
MAASVACAFFFDAEPVGEPGMLALDACALCAKPLARDSDVFMYRGDTPYCSKECRHEQMQLDAVSARQAARRLQRFSAGAESGRAHQGVSVSS

SEQ ID NO: 4560 - protein, 144 aa, Triticum aestivum
RYYHHQYTRQLLGSRLGAATMAITSLQLPSQIHGLTPARNGRTRTRSRATLLSCKHNQSTIVQVASRTSRRDTLAYISSAFFAMFLVAEHAEARTSRQENKRKVMEKLEKVREEALGSKEKKEDTSKESVANLLIPPTLVDAYI

SEQ ID NO: 4561 - protein, 139 aa, Triticum aestivum
TSTRQLLGSRLGATTMAITSLQLPSQIHGLAPARNGRARTRSRATLLSCKHNQSTIVQVASRTSRRSTLAYISSAFFAMFLLAEHAEARTSRQENKRKVMEKLEMVREEALGSKEKKENTNKESVANLLIPPTLVDAYI

SEQ ID NO: 4562 - protein, 124 aa, Triticum aestivum
MAITSLQLPSQIHGLAPARNGRTRTRSRATPLSCKHNQSTIVQVASRTSRRSTLAYISSAFFAMFLLAEHAEARTSRQENKRKVMEKLEMVREEALGSKEKKENTNKESVANLLIPHTLVDAYI

SEQ ID NO: 4563 - protein, 124 aa, Triticum aestivum
MAITSLQLPSQIRGHTPARNGRARTRSRATPLSCKHNQSTIVQVASRTSRRSTLAYISSAFFAMFLVAEHAEARTSRQENKRKVMEKLEKVREEALRSKEKKEDTSKESVANLLMPPTLVDAYI

SEQ ID NO: 4564 - protein, 163 aa, Triticum aestivum
RHEELLRRVEKATEEALAFHGTTTTSTRQLLGSRLGATTMAITSLQLPSQIRGHTPARNGRARTRSRATPLSCKHNQSTIVQVASRTSRRSTLAYISSAFFAMFLVAEHAEARTSRQENKRKVMEKLEKVREEALRSKEKKEDTSKESVANLLMPPTLVDAYI

SEQ ID NO: 4565 - protein, 259 aa, Triticum aestivum
RVRRALPPMSSSLFLCSSQVRYASLPAPLRQPGRQAARLPPAAAAFVSRSLHRPPPLHWTGSGVRMISSCFVVKRRRRRNGISASLFGVGAPEALVIGVVALLVFGPKGLAEAARSLGKTLRAFQPTIRELQDVSRDFKNTLEREIGLDEDPPSISYRPPPPMNNSPRPAVDPDVKPETTVPYTSEELMKVTEEQLAASAIAAWNAQQPPTSEQQEAAAATTPSESTDSALSGGSDGPSAVTEESTSGNTENAKPRDEA

SEQ ID NO: 4566 - protein, 250 aa, Triticum aestivum
SSSLFLCSSQVRYASLPAPLRQPGRQAARLPPAAAAFVSRSLHRPPPLHWTGSGVRMISSCFVVKRRRRRNGISASLFGVGAPEALVIGVVALLVFGPKGLAEAARSLGKTLRAFQPTIRELQDVSRDFKNTLEREIGLDEDPPSISYRPPPPMNNSPRPAVDPDVKPETTVPYTSEELMKVTEEQLAASAIAAWNAQQPPTSEQQEAAAATTPSESTDSALSGGSDGPSAVTEESTSGNTENAKPRDEA

SEQ ID NO: 4567 - protein, 163 aa, Triticum aestivum
  misc_feature (150)..(150): Xaa can be any naturally occurring amino acid
TSHRPPQRAMLSLLPPARLRAAPSDASVTLPRRPAVILPGLGNNTGDYARLAAALRDGHGVPSVVARVSRPDWLRNAAGLADPSYWRGTLRPRPVLDWYLNRVEEAVSEARELSSPDGKLSLIGHSAGGWLARVYMEEFGTSDISLLLTXALPTCLLPKVFLA

SEQ ID NO: 4568 - protein, 305 aa, Avena sativa
MLPLLPPARLRAAPSDVAAAASPRRPAVILPGLGNNTGDYARLAAALRDDHGVPSVVARVSRPDWLRNAAGLADPSYWRGTLRPRPVLDWYLKRVEEAVSEARELCPPDVKLSLVGHSAGGWLARVYMEEFGTSDISLLLTLGTPHLPPPKGVSGVIDQTRGLLYHVEENCAPAVYTPELRYVCIAGRYIQGVPLAGNSVATTEEIVTVDAPSDVAEAVMVSAEDKSARSGSTWRARFVGQGYKQVCGRADVWGDGVVPEISAHLEGALNISFDGVYHSPVGADDERPWYGSPAILEQWVHHLLS

SEQ ID NO: 4569 - protein, 339 aa, Panicum virgatum
AASLREAHAAPRRATPHPHSAGIARTGTAATCSRSSRLRGFVPPPPANAGGTATFPRPSVILPGLGNNTGDYARLAAALRDDHGLPAAVVARVTRPDWLRNAAGLVDANYWRGTLRPRPVLDWYLKRVDEAVSEARELCSPGGKISLIGHSAGGWLARVYMEEFDASDISLLLTLGTPHLPPPKGVPGVIDQTRGLLNYVEKNCAPAVYTPELRYVCIAGRYIQGAPLLGDSTVTSDEVLAVDTTSEGGEAVIISTNDKSTPSSTTWRARFVGQGYKQVCGRADVWGDGVVPEMAAHLEGALNISFDGVYHSPVGADDEQRPWYGSPAILNQWVHHLLS

SEQ ID NO: 4570 - protein, 329 aa, Theobroma cacao
MTLSDDEDKFLANFLESELSNEEERELEEPEAKRLRGGKDDEEEEPKRKGEGASCSNPNPDSGPGQVKNNSSISVPRRIESGTFSKIPPELFPHILKFLSSEDLVSCSLVCSFLNYAAADESLWRRLYCMRWGLLPPTKIRECAWKKLYIQRDEEDMIELVRNCPSEFKEYYIQMQAAKRSQAPLPSQVKDDLIILDKTVADQVSMWKSSRGLADKVVADHACSGETCSYYQIGDVFVCEKTGQVHVCDDTCREVILDPTNELLVCTISGHCFDRLLSPSEMELDPEQQQGGGTDEAEPFMGSGRFARAYLLGYNCDDEKELEAALRFC

SEQ ID NO: 4571 - protein, 176 aa, Saccharum officinarum
MARGENQESQTGNVPAASAASAGAGKGAEGQSVVRRLQSELMALMMGGDPGVSAFPEGDNMLHWVGTIAGSAGTAYEGTSYRLALAFTAEYPYKPPKVRFDTPCFHPNVDVHGNICLDILQDKWSSAYDVRTILLSIQSLLGEPNNESPLNTQAAALWANQEEFRKMVEKLYKPAA

SEQ ID NO: 4572 - protein, 188 aa, Sorghum bicolor
MARGENQEAQSGNVPDASSASAPKPASSSSSAGAGKGLEGQSVVRRLQSELMALMMGGDPGVSAFPDPDGDSMLHWVGTIAGSAGTPYEGTSYRLALAFTAEYPYKPPQVRFDTPCFHPNVDVHGNICLDILQDKWSSAYDVRTVLLSIQSLLGEPNNDSPLNTQAAALWANQEEFRKMVQKLYKPAA

SEQ ID NO: 4573 - protein, 186 aa, Triticum aestivum
MARGENSESHGSGNVPAAPAPGAASASSGKQAPAAARGADGQSVVRRLQSELMALMMGGDPGVSAFPEGDNIFQWVGTIDGSAATAYEGTSYRLALAFPSDYPYKPPKVRFETPCFHPNVDNHGNICLDILQDKWSSAYDVRTILLSIQSLLGEPNNDSPLNTQAAALWANQEEFRKMVEKLYKPA

SEQ ID NO: 4574 - protein, 186 aa, Hordeum vulgare
MARGENSESHGSGNVPAAPAAGAASASSGKQAPAAARGADGQSVVRRLQSELMALMMGGDPGVSAFPEGDNIFQWVGTIDGSAATAYEGTSYRLALAFPSDYPYKPPKVRFETPCFHPNVDNHGNICLDILQDKWSSAYDVRTILLSIQSLLGEPNNDSPLNTQAAALWANQEEFRKMVEKLYKPA

SEQ ID NO: 4575 - protein, 162 aa, Pennisetum glaucum
SGPKPASSAAGKGAEGQSVVRRLQSELMALMMGGDPGVSAFPDGDNIFNWVGTIAGSAGTAYEGTSYRLALAFTAEYPYKPPKVRFDTPCFHPNVDAHGNICLDILQDKWSSAYDVRTILLSIQSLLGEPNNDSPLNTQAAALWANQEEFRKMVEKLYKPTA

SEQ ID NO: 4576 - protein, 409 aa, Sorghum bicolor
MAIAAVRRRLWRGLGTAAAAVASGTDGNLLARLVSEPECRVKATMEEAASSGTHRDGAFWEPLAAALLRASSPTKAHLILEWELEKLLKENIQDCEPYSRIIRFCGQTRNATLAMRVFECVEAKGIQLNTNIFNALINAFLSAGDLLSAMTLYESMEDMDGCNPNSATYDAFICAFSLLGSGHAMMSWYVAAKNAGFTPSIQTFESLITGFVQLNMLDDAKTIFEEMIALEIKPNSTILEASLEILYRKEEASRVRDFLKRVSDGNWELNKAIVVRLTRICLDGGEIDEMEQLLALIQKGPHLSSETQLHHGIIRFYAKADQLADMEHAIYRMLDNGVVFMCPEDVEVIICSYFRHREFDRLDLFLNRIRNLFKLNRSTYDILVAGYRKFDLHERLDSTIADMREAGFA

SEQ ID NO: 4577 - protein, 382 aa, Sorghum bicolor
MALLKAARVADVPTLDVVAPGLVVEAGTASVATMVKSGGGGGGGGGRFSVIGHRGKGMNALASADPRMQEVRENTVRSFNDAARFPVDYVEFDVQVTKDGCPIIFHDNFIFTQEDGKISQKRVTDIHLEDFLQYGPQNEQGKVGKPLLRRLKDGRMVNWNVQSEDALCTLEEAFEKVNTRLGFNVELKFDDSLEYQEEELTRILQAILKVIFEHAKDRPILFSSFQPDAAQLMRKLQGTYPVYFLTNGGTELYTDVRRNSLEEAVKLCLASGMQGIVSEARGIFRHPAAVPKIKEANLSLLTYGTLNNVPEAVYMQHLMGVNGVIVDLVPEITDAVSELIALPEPDLEVDNLSNQAARGATTPNFSQREISFLLRLIPELVQ

SEQ ID NO: 4578 - protein, 385 aa, Saccharum officinarum
MALLKAARVADVPTLDVVAPGLVVEAGSASASAAVAMVKTGAAAAGGGGRFSVIGHRGKGMNALASADPRMQEVRENTVRSFNDAARFPVDYVEFDVQVTKDGCPIIFHDNFIFTQEDGKISQKRVTDIILEDFLQYGPQNEQGKVGKPLLRRLKDGRMVNWNVQSEDALCTLEEAFEKVNPRLGFNVELKFDDSLEYQEEELTRILQAILKVISQHAKDRPILFSSFQPDAAQLMRKLQGTYPVYFLTNGGTELYTDVRRNSLEEAVKLCLASGMQGIVSEARGIFRHPAAVPKIKEANLSLLTYGTLNNVPEAVYMQHLMGVNGVIVDLVPEITDAVSELIALPEPDLEVDNLSNQAARGATTPNFSQREISFLLRLIPELVQ

SEQ ID NO: 4579 - protein, 375 aa, Panicum virgatum
MAQLKAARVADVPTLDVVAPGLVVAGADAASAARAPGGRFSVVGHRGKGMNALASADRRLQEVRENTVRSFNDAARFPVDYVEFDVQVTKDGCPIIFHDNFIYTEEDGIISQKRVTDLQLEDFVQYGPQNEQGKIGKPLLRKMKDGRMLNWNVQSEDALCTLQEAFEKVNPRLGFNVELKFDDYLEYEEEELTRILQAILKVIYEYAKDRPILFSSFQPDAAQLMRKLQSKYSVYFLTNGGTEIYTDVRRNSLEEAIKLCLGSGLQGIVSEARGIFRHPAAIPKIKEANLSLLTYGTLNNVPEAVYMQHLMGVNGVIVDLVPEITEAVSELIALPEPDPEVENLSNNQAAKGAATPNFSQREISFLLRLIPELVQ

SEQ ID NO: 4580 - protein, 379 aa, Brachypodium distachyon
MALLKAARVAEVPTLDVVVPDLAAASARILEVDAAVKKRAGGRFAVIGHRGKGMNALASPDRRLQEVKENSVRSFNEAARFPVDYVEFDVQVTKDGCPIIFHDNFIFTEEHGKISDKRVTDLQLEDFLMYGPQNRQGKNGKPLLRKMKDGRMLNWNVQSDDPLCTLQEAFAKVNPRLGFNVELKFDDYLAYQEEELSRILQAILKVVFEYAKDRPIIFSSFQPDAAQLMRKLQSTYPVYFLTNGGTEIYTDVRRNSLEEAVKLCLTSGMQGIVSEARAIFRFPAAIPKIKEADLSLLTYGTLNNVPEAVYMQHLMGVNGVIVDLVQEITEAVTDLIAVPEPDPEAKDSSSQVTRDAASTPNFTQREISFLLRLIPELVQ

SEQ ID NO: 4581 - protein, 387 aa, Oryza sativa
MAQLKAARVADVPMALDVLAAGAPATSAILEVDAAGARSAAAGGGGGGGGQRFAVIGHRGKGMNALASPDRRMQEVKENSLRSFNEAARFPVDYVEFDVQVTKDGCPVIFHDNFIFTKEDGKILDKRVTDLQLEDFLLYGPQNEQGKGGKPLLRKLKDGRIVNWNVQSDDPLCTLQEAFEKVNPRLGFNIELKFDDNLEYQEEELTCILQAILKVVFEYAKDRPIIFSSFQPDAAQVMRKLQSTYPVYFLTNGGTEIYADVRRNSLEEAIKLCLASGMQGIVSEARGIFRHPAAVPKIKEANLSLLTYGTLNNVPEAVYMQHLMGVNGVIVDLVQEITEAVSELITVPEPDLNADNLSNGAAKDAATPHFSQCEISFLLRLIPELVQ

SEQ ID NO: 4582 - protein, 344 aa, Panicum virgatum
AARALGGRFSVVGHRGKGMNALASPDRRLQEVRENTVRSFNAAARFPVDYVEFDVQVTKDGCPIIFHDNFIYTEEDGKISQKRVTDLQLEDFVQYGQQNEQGKIGKPLVRKMKDGRMLNWNVQSEDALCTLQEAFEKVNPRLGFNVELKFDDDLEYKEEELTRILQAILKVIFEYAKDRPILFSSFQPDAAQLMRKLQSKYPVYFLTNGGTEIYTDVRRNSLEEAIKLCLGSGLQGIVSEARGIFRHPAAIPKIKETNLSLLTYGTLNNVPEAVYMQHLMGVNGVIVDLVPEITEAVSELIALPEPDPEVENLNNNRAAKGAATPNFSQREISFLLRLIPELVQ

SEQ ID NO: 4583 - protein, 414 aa, Sorghum bicolor
MASSTCALALVLALSVGASVARGSEPWWNETQVYTTTANSGGSNGVFVGLTLIQSAAAKGAVCLDGSLPGYHLHRGFGSGANSWLVNLEGGGWCNDVSSCVFRKGSRRGSSNHMERQLQFTGIMSNRPDENPDFYNWNRVKVRYCDGGSFTGDGSDAAAGLYFRGQRIWQAAMDDLMAQGMRYANQALLSGCSAGGVSTILHCDEFRGLFPSNTRVKCLADAGMFLDTVDVSGRREMRSFFNGIVRLQGSGRSLPRSCTARMDKTSCFFPQNVLPNIQTPTFVLNTAYDVWQLQQSVAPRTADPQGLWSKCRTNHAFCNSNQLQFLQGFRNQMLDAVKGFSASRRNGLFINSCFAHCQSERQDTWYANNSPRLGNKKIADAVGDWFFERGDAKYTDCPYPCDGTCHHLVFRGDH

SEQ ID NO: 4584 - protein, 491 aa, Pennisetum glaucum
MGCAQSRIENEEAVARCKERRHLLPLASSAARRSSPSSIRALPPQIRFFPGRAHASPEQGEPEAAKQGGRRRQRTMASRLVAVILAFLLGAGAGAAHGSEPWLNETQVYGTAASSGGGGGNGVFVGLTLIQSAAAKGAVCLDGSLPGYHLHRGFGSGANSWLVNLEGGGWCNDVSSCVFRKGSRRGSSNHMERQLQFTGIMSNRPEENPDFYNWNRVKVRYCDGGSFTGDGSNAAAGLYFRGQRIWQAAMDDLMAQGMRYANQALLAGCSAGGVSTILHCDEFRGLFPSNTRVKCLADAGMFLDTVDVSGRREMRSFFNGIVRLQGSGRSLPRSCTSRMDKTSCFFPQNVVPNIQTPTFILNTAYDVWQLQQSVAPKTADPQGLWSKCRTNHAFCNSNQLQFLQGFRNEMLASVRGFSASTQNGVFINSCFAHCQSERQDTWYASNSPRLGNKRIAEAVGDWYFQRGDAKYTDCAYPCDNTCHNLVFRGDH

SEQ ID NO: 4585 - protein, 389 aa, Setaria italica
PWLNETQVYGTTASSGGSNGVFVGLTLIQSAAAKGAVCLDGSLPGYHLHRGFGSGANSWLVNLEGGGWCNDVSSCVFRKGSRRGSSNHMERQLQFTGIMSNRPEENPDFYNWNRVKVRYCDGGSFTGDGSNAAAGLYFRGQRIWQAAMDDLMAQGMRYANQALLAGCSAGGVSTILHCDEFRGLFPSNTRVKCLADAGMFLDTIDVSGHREMRSFFNGIVRLQGSGRSLPRSCTSRMDKTSCFFPQNVVPNIQTPTFILNTAYDVWQLQQSVAPKAADPQGLWSKCRTNHAFCNSNQLQFLQGFRNEMLDSVRGFSASRQNGVFINSCFAHCQSERQDTWYASNSPRLGNKRIAEAVGDWYFQRGDAKYTDCAYPCDNTCHHLVFRGDH

SEQ ID NO: 4586 - protein, 412 aa, Brachypodium distachyon
MGSWVLLALVLRLFLVGAARGSEQWSNETQVYATNGNSGSNGVFVGLTLIQSAAAKGAVCLDGSLPGYHLHRGFGSGSKNWLVNLEGGGWCNDVKSCVFRKSSRRGSSNHMEKQLQFTGIMSNRPEENPDFYNWNRVKVRYCDGGSFTGDGADAASGLYFRGQRIWQAAMDDLMSQGMRSASQALLSGCSAGGASTILHCDEFRGLFPSNTRVKCLADAGMFLDTVDVAGRREMREFFNGIVRLQGSGRSLPRSCTSRMDKTSCFFPQNVLPNIQTPTFILNTAYDVWQLQQSVAPKTADPQGLWQRCKQNHAFCSGNQLQFLNGFRNEMLDAVKGFSGSRQNGVFINSCFAHCQSERQDTWYSNNSPRLGNRRIAEAVGDWFFERGDAKYTDCTYPCDGTCHHLVFRGRGL

SEQ ID NO: 4587 - protein, 411 aa, Oryza sativa
MGCSWALAALVLGFLVVAVHGSEPWLNQTQVYSTNANSGSNGVFVGITLIQSAAAKGAVCLDGSLPGYHLHRGFGSGANSWLVNLEGGGWCNDVKSCVFRKSSRRGSSNHMESQLQFTGIMSNRPEENPDFYNWNRVKVRYCDGGSFTGDGADASAGLYFRGQRIWQAAMDDLMAQGMRYANQALLSGCSAGGVSTILHCDEFRGLFSGSTNVKCLADAGMFLDFVDVSGQREMRDFFNGIVRLQGSGRSLPRSCTSRMDKTSCFFPQNVVPNIQTPTFILNTAYDVWQLQQSVAPKRADPQGLWRGCRMNHASCNSNQLQFLQGFRNQMLDAVRGFSGARQNGLFINSCFAHCQSERQDTWYAGDSPRLGNKRIAEAVGDWFFDRADAKYTDCAYPCDGTCHHLTFRGDY

SEQ ID NO: 4588 - protein, 471 aa, Triticum aestivum
SCACTCARPASAPRISSFLALATSATIPSPSSRSIPLPAPGLARLPRWDGESSEGQGAMGSWVLLAVVLGSLVGAARGSEPWSNGTQVYSTNANSGSGSNGAFVALTLIQSAAAKGAVCLDGSLPGYHLHRGSGSGSNNWLVNLEGGGWCNDVKSCVFRKGSRRGSSNHMERQLQFTGIMSNRPEENPDFYNWNRVKVRYCDGGSFTGDGADAASGLYFRGQRIWQAAIDDLMAQGMRSASQALLSGCSAGGASAILHCDEFRGMFPSNTRVKCLADAGMFLDSVDIAGRREMRDLFNGIVRLQGSGRSLPRSCTSRMDKTSCFFPQNVLPNIQTPTFILNTAYDVWQLQESLAPRTADPRGLWQSCKQNYASCNSNQLQFLNGFRNEMLNAVKGFSGSGQNGVFINSCFAHCQSERQDTWYSSKSPRLGNKRIAEAVGDWFFERGNAKYTDCAYPCDGTCHHLVFKGRHL

SEQ ID NO: 4589 - protein, 413 aa, Triticum aestivum
MGSWVLLAVVLGSLVGAARGSEPWSNGTQVYSTNANSGSGSNGAFVALTLIQSAAAKGAVCLDGSLPGYHLHRGSGSGSNNWLVNLEGGGWCNDVKSCVFRKGSRRGSSNHMERQLQFTGIMSNRPEENPDFYNWNRVKVRYCDGGSFTGDGADAASGLYFRGQRIWQAAIDDLMAQGMRSASQALLSGCSAGGASAILHCDEFRGMFPSNTRVKCLADAGMFLDSVDIAGRREMRDLFNGIVRLQGSGRSLPRSCTSRMDKTSCFFPQNVLPNIQTPTFILNTAYDVWQLQESLAPRTADPRGLWQSCKQNYASCNSNQLQFLNGFRNEMLNAVKGFSGSGQNGVFINSCFAHCQSERQDTWYSSKSPRLGNKRIAEAVGDWFFERGNAKYTDCAYPCDGTCHHLVFKGRHL

SEQ ID NO: 4590 - protein, 356 aa, Panicum virgatum
KGAVCLDGSLPGYHLHRGFGSGANSWLVNLEGGGWCNDVSSCVLRKGNRRGSSNHMERQLQFTGIMSNRPEENPDFYNWNRVKVRYCDGGSFTGDGSNSAAGLYFRGQRIWQAAMDDLMAQGMRYANQALLAGCSAGGVSTILHCDEFRGLFPSNTKVKCLADAGMFLDTVDVSGRREMRSFFNGIVRLQGSGRSLPRSCTSRMDKTSCFFPQNVVPNIQTPTFILNTAYDVWQLQQSVAPKTADPQGLWSKCRTNHAYCNSNQLQFLQGFRNQMLDSVRGFSASRQNGMFINSCFAHCQSERQDTWYANNSPRLGNKRIAEAVGDWFFERGVAKYTDCAYPCDNTCHHLVFRGDH

SEQ ID NO: 4591 - protein, 183 aa, Triticum aestivum
MDSGEQGETSKAPLSRGVSKGVSMLDLILRVIAVIGTLASAIAMGTTNETLPLFTPFIQFKARYSDLPALTFFVVANSIVSAYLILSLPLSIVHIIRSGAKYSRLVLIIFDAAMLALVTAASSAATAIVYLAHKGNVRANWLAICQQLDSFCERTSGSLVGSFGAMVLLILLILLSAMALARR

SEQ ID NO: 4592 - protein, 183 aa, Triticum aestivum
MDSGEQGETSKAPLSRGVSRGVSILDLILRVIAVISTLASAIAMGTTNETLPLFTPFIQFKARYSDLPALTFFVVANSVVSAYLILSLPVSIAHIIRSGAKYSRLVLIIFDAAMLALVTAASSAATAIVYLAHKGNVRANWLAICQQLDSFCERISGSLVGSFGAMVLLILLIILSAIALARR

SEQ ID NO: 4593 - protein, 183 aa, Triticum aestivum
MDSGEQGETSKAPLSRGVSRGVSILDLILRVIAVISTLASAIAMGTTNETLPLFTPFIQFKARYSDLPALTFFVVANSIVSAYLILSLPVSIAHIIRSGAKYSRLVLIIFDAAMLALVTAASSAATAIVYLAHKGNVRANWLAICQQLDSFCERTSGSLVGSFGAMVLLILLIILSAMALARR

SEQ ID NO: 4594 - protein, 874 aa, Sorghum bicolor
MSPAAASASPDDRIRNYEDFVRVHAYLLAAAGIPPSLHQRLYRKLADEVFDGGEVFAVEPCEDGRQRRLVLSADESLRKESDVFLVDHAWSFRLPDALKQLREVPGLAERMAALMCVDLDRRIETEEADEKDGHESGSLEHVLQVVEKEKARVQERGRDSAAWLELEELGIDDDMLVALDLSAKFPNLVALNLWGNKLQDLEKVMQEIRKCAKLKALWLNENPVLGKSIDKAILDGLSGLEIYNSHFTSKAGEWALGFCADIVGADNPCSSVESTLLGSIEIIDLSDRCIHKLPEVLSPSNFPSLSKLNIRGNPLDQISGDDLLKLFGGFTKLQELEVDIPGPLGNSAISILESLPNLSLLNGVDSSSIIESGKHIVDSALEPRLPEWSPEEPLAERVIGAMWLYLMTYRLADEEKIDETPVWYVMDELGSAMRHSDYANFRIAPFLFMPEGKLDTAISYTILWPTHDVHTGEECTRDFLFGIGEDKQRSARLTAWFRTPENYFIQEFRRYQEQLQSNSICSSTKIEETPSTKSIRPSDGRALRVYTDIPHVEEFLTRPEFVLTTDPKEADIIWVSMQVDSEVKKAVGLTDQQYTNQFPFEACLVMKHHLAETIHKAWGSPEWLQPTYNLETHLSPLIGDYFVRKRDGMDNLWIMKPWNMARTIDTTVTGDLSAIIRLMETGPKICQKYIERPALFQGRKFDLRYIVLVRSIRPLEIFLSDVFWVRLANNQYTLEKTSFFEYETHFTVMNYIGRMKHMNTPEFVKEFEKEHQVKWLDIHESIRSTIRCVFESAAAVHPEMQNPFSRAMYGVDVMLDNRFEPKILEVTYCPDCGRACKYDTQALVGSQGTIRGRDFFNAVFGCLFLDEQTNVSPL

SEQ ID NO: 4595 - protein, 872 aa, Brachypodium distachyon
MSPAAAAVPCDDRIRSYDDFARVHAYLLAAAGVPPSLHQRLYRKLADEVFDGGESFAVEPCEGGRQRRLVLASETPLGRESDVFLVDHAWSFRLSDALKQLREVPGLAERMSALMCVDLDRRTEIEESDEQDREMSGGLEHVLQVVQKERTRTQEKGSDFAAWLELEELGIDDDMLVSLDLSANFPNLVALNLWGNKLQDPEKIMQEIRKCGRLKALWLNENPILNQGIDKAVLDGLPELEIYNSHFTRKAREWALGFCGNMVGADNPCSSVESISLDNIATLDLSDRCIHKLPEVFCPSKLSSLSNLNIRGNPLDQVPGDDLLNLFSGFTQLQELEVDIPGPLGNSALPILEALPNLTLLNGVNALSIAESGKHVVDSALQPRVPEWSPEESLAERVIGAMWLYLMTYRLADEEKVDETPVWYVMDELGSAIRHSDDANFRIAPFLFMPEGKLASAISYTILWPVGDVHTGDECTRDFLFGIGEDKQRSARLTAWFHTPENYFIQEFRKYQEQLQSTGICPSTKEKPSTKSLRPSDGRALRVFTDIPQVDEFLTRPEFVLTTDPKDADIIWVSMQVDSELKSSLELTDQQYTNQFPFEACLVMKHHLADTIHKAWGSPEWLQPTYNLETHLSQLIGDYCVRKQDNMDNLWIMKPWNMARTIDTTVTGDLSAIIRLMETGPKICQKYIECPALFQGRKFDIRYIVLVRSICPLEIFLSDVFWVRLANNQYTLEKTSLFEYETHFTVMNYTGRMNHMNTPEFVKEFEKEHQVKWLDIHESICNMIRRVFESASAVHPEMQNTFSRAIYGVDVMLDNRFKPKILEVTYCPDCTRACKYDTSAVVGNQGAIRGSDFFNTVFGCLFLDDLTNVSPL

SEQ ID NO: 4596 - protein, 870 aa, Oryza sativa
MSPAAASPDDRIRSYEDFARVHAYLLAASGIPPSLHQRLYRKLADEVFDGGEAFSVEPCEGGRQRRLVLAAEWTLGRESDVFLVDHAWSFRLSDALKQLREVPGLAERMAALMCVDLDERTELEEADEQDNGNGGSLESALEVVEKERTRIQEKGSDFAAWLELEELGIDDDMLIALDLSSKFPNMVALNLWGNKLQDPEKIMKGIGECRRLKALWLNENPALKEGVDKVILDGLPELEIYNSHFTRKAGEWALGFCGDIIGADNPCSSAESIPLENIASLDLSDRCIHKLPVVFSPRKLSSLLSLNIRGNPLDQMSSDDLLKLISGFTQLQELEVDIPGSLGNSAISILECLPNLSLLNGINVASIIESGKHIIDSALKPRLPEWSPQESLPERVIGAMWLYLMTYRLADEEKIDETPVWYVMDELGSAMRHSDDANFRIAPFLFMPDGKLASAISYTILWPVHDVHTGEECTRDFLFGVGEDKQRSARLTAWFHTPENYFIQEFRKYKEQLQSSSICPSRKVTPVTKSIRPSDGHALRVFTDIPQVEEFLTRPEFVLTSDPKEADIIWVSMQVDSELKNALGLTDQQYTNQFPFEACLVMKHHLAETIHKAWGSPEWLQPTYNLETHLSPLIGDYCVRKRDGMDNLWIMKPWNMARTIDTTVTGDLSAIIRLMETGPKICQKYIECPALFQGRKFDLRYIVFVRSICPLEIFLSDVFWVRLANNQYTLEKTSFFEYETHFTVMNYIGRMNHMNTPEFVKEFEKEHQVKWLEIHGRIRDMIRCVFESATAVHPEMQNPFSRAIYGVDVMLDNKFNPKILEVTYCPDCTRACKYDTQALVGSQGVIRGTEFFNTVFGCLFLDELKDVSPL

SEQ ID NO: 4597 - protein, 421 aa, Panicum virgatum
ASEEPLGKESDVFLVDHAWSFRLPDALKQLREVPGLAERMAALMCVDLDRKVETEESEDEQDDEKNVSLEHVLQVVETERARVQERGTDSAAWLELEELGIDDDMLVTLDLSAKFPNLVALNLWGNRLQDTEKVIQEIRKCPKLKALWLNDNPVLGKGIDKAVLDSLSGLEIYNSRFTSKAGEWALSFCADIVGADNPCSFVESTLLDSIATIDLSDRCIHKLPEALSPSKLPSLSKLNIRGNPLDQISGDDLLKLLSGFTQLQELEVDIPGPLGNSAISILESLPNLSFLNGVNSSSIIESGKHIVDSALQPRLPEWSPEESLAERVIGAMWLYLMTYRLADEEKIDETPVWYVMDELGSAMRHSDIPNFRIAPFLFMPEGKLASAISYTVLWPTHDVHTGEECTRDFLFGIGEEKTTFS

SEQ ID NO: 4598 - protein, 871 aa, Triticum aestivum
MSPAAAAPAPCDDRIRTFEDFARVHQFLLIAAGVPPSLHRRLYHKLAAEVFDGGERFYVEPCEEGRQRRLVLASDTALRGESDVFLVDHAWSFRLSDALKQLREVPGLAERMAALMCVDLDRKTEVEESDEQGSENGGGLEHVLQVLENEKARIQERGSYFAAWLELEELGIDDDMLVALDLSANFPNLVALNLWGNKLQDPEKVMREIGKCGRLKALWLNENPILNQCTEKDVLDGLPELEIYNSHFTRKAREWALGFCGDMVGAENPCLSVGNISLDNIVTLDLSDRSIHKLPEVFSSKLSSLSKLNIRGNPLDQMSGDDLLKLFSGFTQLQELEVDIPGPLGDSAISILESLPNINLLNGVNASTIVENAKHVVDSALRPRVPEWSPEESLAERVIGAMWLYLMTYRLADEEKFDETPIWYVMDELGSAMRHSDDANFRISPFLFMPEGKLASAISYTILWPICDVHTGEECTRDFLFGIGEDKQRSARLTAWFHTPEKYFIQEFRKYQEQLQSTTICPTKEAPSTKSALPSDGRPLRVFTDIPQVEEFLTRPEFVLTTDPKDADIIWAGMQIDSELKSSLGLTDQQYMNQFPFEACLVMKHHLADTIHRAWGSPEWLQPTYNLETHLSQLIGDYSVRKRDGKDNLWIMKPWNMARTIDTTVSGDLSAIIRLMETGPKICQKYIECPALFQGRKFDLRYIVLVRSICPLDILLCDVFWVRLANNQYTLEKTSLFEYETHFTVMNYNGRMNHMNTPEFVKAFEKEHQVKWLEIHESIRIMIRRVFESASAVHPEMQNSFCRAIYGVDVMLDDKFKPKILEVTYCPDCTRACQYDTQALVGSQGPIRGSDFFNTVFGCLFLDDLTNVSPL

SEQ ID NO: 4599 - protein, 275 aa, Saccharum officinarum
MASEVEDDAAAAGAPLVANGAADVRRRRDQAKAILSKQAVKIATKAEQHERFIFKVTHLLGVLGFGGFCYLLGARPQDVPYVYCLFYVIFVPLRWIYYRYKKWHYYLLDFCYYANTFLLVMILFYPKDEKLFMVCFSFAEGPLAWALIVWRCSLVFSSFDKLVSVLIHLLPGIVLFTIRWWNPQTFAAMHPEGRDARDTWPYVEDKSYLWTWLFFVPLAAYTLWQLMYFLIVNVLRRQRLLRDPEVMTSYRELITTSALEAPPKPASSPWHPPCL

SEQ ID NO: 4600 - protein, 263 aa, Saccharum officinarum
GAPLVANGAADVRRRRDQAKAILSKQAVKIATKAEQHERFIFKVTHLLGVLGFGGFCYLLGARPQDVPYVYCLFYVIFVPLRWIYYRYKKWHYYLLDFCYYANTFLLVMILFYPKDEKLFMVCFSFAEGPLAWALIVWRCSLVFSSFDKLVSVLIHLLPGIVLFTIRWWNPQTFAAMHPEGRDARDTWPYVEDKSYLWTWLFFVPLAAYTLWQLMYFLIVNVLRRQRLLRDPEVMTSYRELITTSALEAPPKPASSPWHPPCL

SEQ ID NO: 4601 - protein, 242 aa, Pennisetum glaucum
MAAAAPASSVKEVLPSPLTSVSEPPPLFDGTTRLYVAYHCPYAQRAWIARNYKRLQDKIKIVAIDLADRPSWYKEKVYPENKVPSLEHNNQVKGESLDLVKYIESNFEGPSLLPDDPAKKQFAEELLDYTDEFNKALYSSILSKEDVSEETVAALDKIEEALGKFNDGPFFLGQFSLVDIAYVPFIERFQIFFSNIKNYDITKGRPNLQKFIEEVNKIDAYTQTKQDPQFLLEHTKKRLGIA

SEQ ID NO: 4602 - protein, 299 aa, Hordeum vulgare
MSSLAFPCRSSPLTPASNSPPVPSPCIKIRRSRRAAPHRHLIAARNSSSPRTVAMAAAAAAAPVISPKENLPPSLTSTSEPPPLFDGTTRLYVAYHCPYAQRAWIARNYKGLQDKIKIVAVDLADRPAWYKEKVYPQNKVPSLEHNNQVKGESLDLVKYIDSNFDGPALLPDDSAKKQFSEELLVYTDEFNKALYSSITSKGDVAEETVAALDKIEAALGKFSDGPFFLGQFSLVDIAYVPFIERFQIFFSGIKNYDITKDRPNIQKFIEEVNKIDAYTQTKLDPQFLLQHTKKRLGIE

SEQ ID NO: 4603 - protein, 292 aa, Triticum aestivum
RSSPLTPASISPPVPSPCIKIRRSRPAAPHRRLIAARSSSSPRTVAMAAAAAAAAPVISPKENLPPSLTSTSEPPPLFGGTTRLYVAYHCPYAQRAWIARNYKGLQDKIKIVGIDLANRPAWYKEKVYPQNKVPSLEHNNQVKGESLDLVKYIDSNFDGPALLPDDSAKKQFAEELLVYTDEFNKALYSSITSKGDVAEETVAALDKIEAALGKFSDGPFFLGQFSLVDIAYVPFIERFQIFFSGIKNYDITKDRPNIQKFIEEVNKIDAYTQTKLDPQFLLEHTKKRLGIE

SEQ ID NO: 4604 - protein, 319 aa, Triticum aestivum
HHSAIGVSNPHLLPHKLAPMTSLTFPCRSSPLTPASISPPVPSPCIKIRRSRRAAPHRRLIAARSSSSPRTVAMAAAAAAAAPVISPKENLPPSLTSTSEPPPLFDGTTRLYVAYHCPYAQRAWIARNYKGLQDKIKIIGIDLADRPAWYKEKVYPQNKVPSLEHNNEVKGESLDLVKYIDSNFDGPALLPDDSAKKQFAEELLVYTDESNKALYSSITSKGDVAEETVAALDKIEAALGKFSDGPFFLGQFSLVDIAYVPFIERFQIFFSGIKNYDITKDRPNIQKFIEEVNKIDAYTQTKLDPQFLLEHTKKRLGIE

SEQ ID NO: 4605 - protein, 300 aa, Triticum aestivum
MTSLTFPCRSSPLTPASISPPVPSPCIKIRRSRRAAPHRRLIAARSSSSPRTVAMAAAAAAAAPVISPKENLPPSLTSTSEPPPLFDGTTRLYVAYHCPYAQRAWIARNYKGLQDKIKIIGIDLADRPAWYKEKVYPQNKVPSLEHNNEVKGESLDLVKYIDSNFDGPALLPDDSAKKQFAEELLVYTDESNKALYSSITSKGDVAEETVAALDKIEAALGKFSDGPFFLGQFSLVDIAYVPFIERFQIFFSGIKNYDITKDRPNIQKFIEEVNKIDAYTQTKLDPQFLLEHTKKRLGIE

SEQ ID NO: 4606 - protein, 275 aa, Festuca arundinacea
  misc_feature (26)..(26): Xaa can be any naturally occurring amino acid
  misc_feature (137)..(137): Xaa can be any naturally occurring amino acid
  misc_feature (141)..(141): Xaa can be any naturally occurring amino acid
  misc_feature (216)..(216): Xaa can be any naturally occurring amino acid
  misc_feature (227)..(227): Xaa can be any naturally occurring amino acid
  misc_feature (258)..(258): Xaa can be any naturally occurring amino acid
GTRIRRSRRTANRHFHRLAASTRNSXRTVAMAATAAAAPVISPKENLPPILTSTSEPPPLFDGTTRLYVAYHCPYAQRAWIARNYKGLQDTIKIVAIDLADRPAWYKEKVYPGNKVPSLEHNNQVKGESLDLVKYIXSNFXGPALLPDDSEKKQFADELLVYTDEFSKAAYSSITSKGDVSDETVAALDKIEAALGKFTDGPFFLGQFSLVDIAYXPFIERFQIFFXGIKNYDITKGRPNLQKFVEEVNKIDAYTQTXLDPQFLLEQTKKRLGIE

SEQ ID NO: 4607 - protein, 849 aa, Sorghum bicolor
MSDRSSSAGPTFFPFGPQAEAWDVTFKVKYGDTLKRFYGCANGNHFDMNLSALRAKIATAFKFGSDADFILTYTDEDGDIVMLDDDDDLRDAALRQKLNPLRITVQLKKNQPTDKKDVSAPVKPITQDSLSQIMSAIEFLKPVQEDSLAHIKSAIGEAIKSVPEPIPDALAKLSHEILDAAPPPLAELMKPFAQLMAPNNNGNGPSDVHAEGSSTSSSGVTQTPAPAPAPVPAEAKNEPKVTPSLGLRAVFKEAASPVPNAGASQVQQPSMYPSVEELLFPRNSVDKPVCKGKTDAQSKGKSVMSSLTQPAPYSLPTHAPPPPPPCISEWSRPRRSLQHPWQYEDNAKATSDSRWRIPMYKMPYAPPPPAVPPPGYGPSPHFPYPGRLLSSGHPYGDLAGNMENSAQRSLHRWIQCDGCGVQPIVGPRYKSNVKEDYDLCDSCFQRMGNEMEYTKIDKPISPHKFLRDPHATRKVHHTRVLMKSKREKLESRFILDVTVLDGTLMTPSTSFTKIWRMHNNGSVVWPLGTQLIWVGGDQFALQSSVPLEIPVDGFPVDKEIDVAVDFVAPRRPGRYISYWRLASPSGQKFGQRVWVHIQVEDPSFVNDNNRSAAINLNLPPESNSANTTNLIDVNIEPVDSALTAKRTKEFHFCSTDVSGPKKSLPATLVATSSSAAAPANPTGDVPMSSAPAAAFVPSVNVPMPEVVTHTPSPAMPVLPTTIPMSAPVSAPAIAPVSASGAVPAPPPVSAVVPELSDLDVHNEEKLLRELEEMGFRQIDLNKEILRQNNYNLEQSVDDLCGVNEWDPLLAELEEMGFDDTEVNKELLAKNGGSIKRAVMDLIAREKKDK

SEQ ID NO: 4608 - protein, 851 aa, Saccharum officinarum
MSDRSSSTGPTFFPFGPQAEAWDVTFKVKYGDTLKRFYGCVNGNHFDMNLSALRAKIVTAFKFGADADFVLTYADEDGDIVMLDDDDDLRDAALRQKLNPLRITVQLKKNQPTEKKDASAPVKPTAQDPLSQIMSAIEGLKPVQEDSLAHIKSAIGEAIKSIPEPIPDALAKLSHEILDAAPPPLAELMKPFAQLMAPNSNGNGPSHVHAEGSSSSSSGVTQTQAPAPAPAPAEAKTEPKVKPSLGLRAMLKEAAAPVPNAGASQVQQPSMYPSVEELLFPCNSVDKSVCKGRTDAQNKGKSVMSSVTQPAPYSLPTHAPPPPPSCISEWSRPRRSQQHPWQYEDNAKATSDRWHIPMYKMPYAPPSSAVPPPGYGPFPHFSYPGRLLSSGHPYGDLAGNMENSAARSLHRWIQCDGCGVQPIVGPRYKSNVKEDYDLCDSCFQRMGNEMEYTKIDKPILPHRFLRDPHANRKVHHTRVLMKSKREKLESRFILDVTVIDGTLMTPSTPFTKIWRMHNNGSVVWPLGTQLIWVGGDQFALQTSVPLEIPVDGFPVDKEIDVAVDFVAPTRPGRYISYWRLASPSGQKFGQRVWVHIQVEDPSFVNDNSKNAAINLNLPPESNSANTTNLIDVNIEPVDSALSAHAKRTKEFHFCSTDVSEPKKFLPATLVNTSLSAAAPANPTGDVSISSTSAAAFVPSVNVPMPEVVTTHTSLPAMPVLPTNIPISAPVSAPAIAPVPVPPPVSAPQPVNAVVPELSDLDVHNEEKLLRELEEMGFRQIDLNKEILRQNNYNLEQSVDDLCGVNEWDPLLAELEEMGFDDTEVNKELLAKNGGSIKRAVMDLIAREKKDK

SEQ ID NO: 4609 - protein, 853 aa, Saccharum officinarum
MSDRSSSTGPTFFPFGPQAEAWDVTFKVKYGDTLKRFYGCVNGNHFDMNLSALRAKIVTAFKFGADADFVLTYADEDGDIVMLDDDDDLRDAALRQKLNPLRITVQLKKNQPTEKKDASAPVKPTAQDPLSQIMSAIEGLKPVQEDSLAHIKSAIGEAIKSIPEPIPDALAKLSHEILDAAPPPLAELMKPFAQLMAPNSNGNGPSHVHAEGSSSSSSGVTQTQAPAPAPAPAPAEAKTEPKVKPSLGLRAMLKEAAAPVPNAGASQVQQPSMYPSVEELLFPCNSVDKSVCKGRTDAQNKGKSVMSSVTQPAPYSLPTHAPPPPPSCISEWSRPRRSQQHPWQYEDNAKATSDRWHIPMYKMPYAPPSSAVPPPGYGPFPHFSYPGRLLSSGHPYGDLAGNMENSAARSLHRWIQCDGCGVQPIVGPRYKSNVKEDYDLCDSCFQRMGNEMEYTKIDKPILPHRFLRDPHANRKVHHTRVLMKSKREKLESRFILDVTVIDGTLMTPSTPFTKIWRMHNNGSVVWPLGTQLIWVGGDQFALQTSVPLEIPVDGFPVDKEIDVAVDFVAPTRPGRYISYWRLASPSGQKFGQRVWVHIQVEDPSFVNDNSKNAAINLNLPPESNSANTTNLIDVNIEPVDSALSAHAKRTKEFHFCSTDVSEPKKFLPATLVNTSLSAAAPANPTGDVSISSTSAAAFVPSVNVPMPEVVTTHTSLPAMPVLPTNIPISAPVSAPAIAPVPVPPPVSAPQPVNAVVPELSDLDVHNEEKLLRELEEMGFRQIDLNKEILRQNNYNLEQSVDDLCGVNEWDPLLAELEEMGFDDTEVNKELLAKNGGSIKRAVMDLIAREKKDK

SEQ ID NO: 4610 - protein, 119 aa, Sorghum bicolor
MAEAPETAAPTPPPSPPAPVTSSPPPKSGIPPRYDLDAKWDACLDLSIRRVAYSSLAGAFAGLLLFRSPTTRWASVALGAGVGIGAAYTECSYLFNGAPPKWSPKVSTIPSAHSEGGDK

SEQ ID NO: 4611 - protein, 107 aa, Saccharum officinarum
MAEAPDTAAPSPPPKSGIPPRYDLDAKWDACLDLSIRRVAYSSLAGAFAGLLLFRSPTTRWASVALGAGVGIGAAYTECSYLFNGAPPKWSPKVSTIPSAHSEGKDK

SEQ ID NO: 4612 - protein, 116 aa, Zea mays
MAEAPETAAPTQPPPAPAASSPPPKSGIPPRYDLDAKWDACLDLSIRRVAYSSLGGAFAGLLLFRSPTTRWASVALGAGVGIGAAYTECSYLFNGAPKCSPKVSTITSAHSDGGDK

SEQ ID NO: 4613 - protein, 107 aa, Saccharum officinarum
MAEAPDTAAPTPPPKSGIPPRYDLDAKWDACLDLSIRRVAYSSLAGAFAGLLLFRSPTTRWASVALGAGVGIGAAYTECSYLFNGAPPKWSPKVSTIPSAHSEGKDK

SEQ ID NO: 4614 - protein, 156 aa, Panicum virgatum
QVQATNAAPAVSASLCVSFCLPRIASDPLLVSRNPRHGRSAPENAAPTPTPTPPAPATSSPPPKSGIPPRYDLDAKWDACLDLSIRRVAYSSLAGAFAGLLLFRSPTTRWASVALGAGVGIGAAYTECSYLFNGAPPKWSPKVGTVPSAYSEGEDK

SEQ ID NO: 4615 - protein, 243 aa, Zea mays
MDKVLLDTFVDYYNKGDRCQNGWKSHVYTAAVKNVCEKCNATITKENISSRSKTFDKHYNIINGLLSTSGFGWDWEKNKLKVDSDTVWDEYVEEAKGYRHKVVKFWDLLSLVYNKDQANREGAKTAAGSSKEMAKENDTGGKDAPYSVSSSSSLKRQRSDDSFNSMWCDKFDMLTSALKDDGPKLPSSAEVLAALQEVEGLDEDTELELYDILTSNARKFESMMALPMERRKRWLMMQLRKCR

SEQ ID NO: 4616 - protein, 104 aa, Zea mays
MDKVLLDTFVDYYNKGDRCQNGWKSHVYTTAMKNVCEKCNVTIRKENISSRSKTFDRHYNIITGLLSTSGFGWIGRRTSSKLIVTLYGMSTLRGIRRSTKPSVQ

SEQ ID NO: 4617 - protein, 275 aa, Zea mays
MGMGPLENAASAAESAALPEAGAAAAAGSYAVLQCGEDSEYVRQKYGGYFAVFRALLEEDGESWRVYGAVRGELPTDAEAAGFDGFVISGSCSDAHGDEPWILDLVGLIRRLHAAGKRILGVCFGHQILCRALGGRTGRSTKGWDIGVSCIHPTAAAARLFAPLKLPVHMPVIEFHHDEVWELPAGAEVLARSDQTRVEMFRLGDRAMGVQGHPEYSKDILMSIADRLLRHNHILDCQVDVAKASFDVRQPDKELWKKVCRGFLKGRLQSQQQFH

SEQ ID NO: 4618 - protein, 273 aa, Setaria italica
MGMGPLESAAAAVAAVPVAAGSYAVLQCGDDSEYVRKAYNGYFQVFRALLEEDGETWRVYRALRGELPTDAEAAGFDGFVISGSCADAHGDEPWILALVDLIRRLHAAGKRILGVCFGHQLLCRALGGRTGRSTKGWDIGVSCIHPTAAAARLFAPLKLPVHMPVIEFHQDEVWELPPNAEVLARSDKTRVEMFRYGDRVMGVQGHPEYSKDILMSIADRLLQRSLILDCQVDVAKASFDVRQPDKELWKKVCRGFLKGRLQSQQEQQQVVVL

SEQ ID NO: 4619 - protein, 282 aa, Brachypodium distachyon
MGMGPLENAAPAAADGAAPVMAAPAVVAKAGSYAVLQCGEDSEYVRKAYGGYFEVFRALLAEEGERWQVYKAVRGELPGEAEAAGFDGFVISGSCSDAHSDEPWILALVDLIRRQHAAGKRVLGVCFGHQVLCRALGGKTGRSCKGWDIGVSCMHPTAAAARLFAPLKLPVHMPIIEFHQDEVWELPPGAEVLARSDKTSVEMFRLGDHAMGVQGHPEYSKDILMSIADRLLQRDLILDCQVDVAKASFDVRQPDKELWKKVCRGFLKARLQSQQQKQHKLL

SEQ ID NO: 4620 - protein, 323 aa, Triticum aestivum
  misc_feature (117)..(119): Xaa can be any naturally occurring amino acid
FGTRASQPASAIPSVDAHSPVRPPALPRPFLPRSLGRGRVAMGMGPLENAAAVDGAPVVTAAAAGGGSYALLQCGEDSAYVRDAYGGYFEVFRALLAEDGERWRVYRAVRGELPSDXXXAGIDGFVISGSCSDAHGDEPWILALVDLIRRQLAAGKRVLGVCFGHQILCRALGGKTGRSCKGWDIGVSCIHPTAAAARLFAPLKMPVHLPIIEFHQDEVWELPAHAEVLARSDKTGVEMFRLGDRAMGVQGHPEYSKDILMSIADRLLRQNLLLDCQVDVAKASFDVRQPDKEFWKKVCRGFLKGRLQPQQQQQPKQQHKVQL

SEQ ID NO: 4621 - protein, 263 aa, Pennisetum glaucum
VPVAAAPAAGSYALLQCGEDSEYVRKAYNGYFQVFRALLEEDGETWRAYRAIRGELPTDAEAAGFDGFVISGSCADAHGDEPWILALVDLVRRLHAAGKRILGVCFGHQLLCRALGGRTGRSTKGWDIGVSCIHPTSAAARLFAPLKLPVHMPVIEFHQDEVWELPPNAEVLARSDKTRVEMFRYGDGVMGVQGHPEYSKDILMSIADRLLQRSLILDCQVDVAKASFDVRQPDKELWKKVCRGFLKGRLQSQQQQEVVVVAL

SEQ ID NO: 4622 - protein, 297 aa, Avena sativa
MGMGPQLENAAASAVAVAVPPATAPAPAMIPAAAAAAGSYALLQCGEDSAYVRDAYGGYFNVFRALLEEDGERWRVYRAVRGELPSDAEAAALDGFVISGSCSDAHGDEPWILALVDLIRRAHAAGKRILGVCFGHQILCRALGGRTGRSTKGWDIGVSCMHPTAAAARLFAPLKLPVHMPIIEFHHDEVWDLPPHAEVLARSDKTGVEMFRLGDRAMGVQGHPEYSKDILMSIADRLLQHNLILDCQVDVAKASFDVRTPDKELWKKVCRGFLKGRLQSQQQQPQPQQQKQHNKLL

SEQ ID NO: 4623 - protein, 283 aa, Hordeum vulgare
MGMGPLETAVEAGRAAAPVPVVTAAGGGTYALLQCGEDSAYVRDAYGGYFEVFRALLAEDGERWRVYRAVRGELPSDEDAAGVDGFVISGSCSDAHGDEPWILALVDLVRRQLAAGKRVLGVCFGHQVLCRALGGKTGRSCKGWDIGVSCIHPTAAAARLFAPLKMPVHLPIIEFHQDEVWELPPHAEVLARSDKTGVEMFRLGDRAMGVQGHPEYSKDILMSIADRLLRQNLLLGCQVDVAKASFDVRQPDKEFWKKVCRGFLKGRLQPQQQQQKQQHKLQL

SEQ ID NO: 4624 - protein, 282 aa, Triticum aestivum
MGMGPLENAAAVDGAPVVTAAAAGGGSYALLQCGEDSAYVRDAYGGYFEVFRALLAEDGERWRVYRAVRGELPSDEEVAGIDGFVISGSCSDAHGDEPWILALVDLIRRQLAAGKRVLGVCFGHQILCRALGGKTGRSCKGWDIGVSCIHPTAAAARLFAPLKMPVHLPIIEFHQDEVWELPAHAEVLARSDKTGVEMFRLGDRAMGVQGHPEYSKDILMSIADRLLRQNLLLDCQVDVAKASFDVRQPDKEFWKKVCRGFLKGRLQPQQQQQPKQQHKLQL

SEQ ID NO: 4625 - protein, 1172 aa, Brachypodium distachyon
MEDVCEGKDFSFPAEEERVLKLWAELDAFHEQLRRTEGGEEFIFYDGPPFATGLPHYGHILAGTIKDVVTRHQSMRGRHVARRFGWDCHGLPVEFEIDKQLGITNRQQVLDYGIARYNEACRSIVTKYVKEWEAVVTRTGRWIDFKADYKTMDINFMESVWWVFGQLWAKDLVYKGFKVMPYSTGCKTALSNFEAGLDYRTVPDPAVMVSFPVVSDVDNAALVAWTTTPWTLPSNLALCVNANLVYSKVKDKSNGTVYIVAESRLGQLPVKAKASGKKQAPPKGSTPDGGQGGLDTESYELLAKFPGSCLVGLKYTPLFDFFLEFKETAFRVIADNYVTDDSGTGVVHCAPAFGEDDHRVCLAAGIIEASGLVVAVDDDGCFIEKITEFRGRHVKEADKDIISAVKDKGRLVSKGSIEHSYPFCWRSGTPLIYRAVPSWFIKVEKIRDQLLECNKETYWVPDYVKEKRFHNWLEGARDWAVSRSRFWGTPLPVWISQDGEEIVVMDSIEKLEKLSGVKVTDLHRHHIDDITIPSSRGPEFGVLKRVEDVFDCWFESGSMPYAYIHYPFENRELFEKNFPGNFVAEGLDQTRGWFYTLMVLSTALFGKPAFKNLICNGLVLAEDGKKMSKSKQNYPSPVGVINEYGADALRLYLVNSPVVRAESLRFKRIGVYGVVKDVFLPWYNAYRFLVQNTKRLEVEGLAAFSPIDQDSLRKSSNVLDHWIHSATESLVSFVHQEMDAYRLYTVVPYLVKYIDNLTNIYVRFNRKRLKGRTGEEDCRISLSTLYHALVTTCVVMAPFTPFFTEALYQNLRKVSSKSEESIHFCTFPSTTGERDERVEQSVNRMMTIIDLARNIRERHSKALKTPLKEMVVVHPDNEFLEDITGKLKEYVMEEMNVKTVTPCNDPMMYASLRAEPNFSVLGKRLGKDMGKVSNEVKKMSQEQILAFEQSGEISFHGHCLKLDDIKVVRQFKRPADVSEKEIDAAGDGDVLVILDLRADQSLFEAGMAREVVNKIQKLRKTAQLEPTDLIDVYYKSVNDDSNALEEIVQSQDQYIRDVLGNSLVPKAMAPSDMVVMCEESHIVHDMSFVIYIARCIPVLTPELLPHASGNSDHVDALRVYLLSRSIYRLKNEFQTGNGKITVKCIEGYPPIDLHLGKHVFLSAGDFYQANRS

SEQ ID NO: 4626 - protein, 1170 aa, Sorghum bicolor
MDDVCEGKDFSFPQQEERVLQLWAKLDAFHEQLRRTEGGEEFVFYDGPPFATGLPHYGHILAGTIKDVVTRHQSMRGRHVSRRFGWDCHGLPVEFEIDKALGITNRQQVFDLGIGKYNETCRSIVTKYVSEWEAMVTRTGRWIDFKNDYKTMDINFMESVWWVFAQLWEKDLVYKGFKVMPYSTGCKTALSNFEAALDYRTVPDPAVMVSFPIVGDADNAALVAWTTTPWTLPSNLALCVNANLTYAKVKDKSNGAVYVIAESRLGQLPVKAKSSGKKQAPSKGGNAEAVQDGLDKESYELLAKIPGASLVGLKYTPLFDFFIELQETAFRVIADNYVTDDSGTGVVHCAPAFGEDDHRVCLAAGIFETAGLVVAVDDDGCFIEKISVFKGRYVKEADKDIINADKGRLVSKGSIEHSYPFCWRSGTPLIYRAVPSWFVKVEKIKDQLLECNKETYWVPDYVKEKRFHNWLEGARDWAVSRSRFWGTPLPLWISQDGEEIVVIDSIEKLEKLSGVKVTDLHRHYVDDITIPSKRGPEFGVLKRVDDVFDCWFESGSMPYAYIHYPFENRELFEKNFPGNFVAEGLDQTRGWFYTLMVLSTALFGKPAFKNLICNGLVLAEDGKKMSKSKKNYPPPKDLIDEFGADSLRLYLVNSPVVRAESLRFKRAGVFAVVKDVFLPWYNAYRFFVQNAKRLEFEGLASFSPMEQAVLLKSSNVLDHWINSATESLVSFVHQEMDAYRLYTVVPYLVKYIDYLTNIYVRLNRKRFKGRTGEEDCRISLSTLYHVLVTTCVVMAPFTPFFTEVLYQNLRKVSSKSEESIHFCKFPSTTGERDERVEQSVNRMVTIIDLARNIRERHNKALKTPLKEMVVVHPDNDFLEDITGKLKEYVMEEINVKTVTPCNDPLVYASLRAEPNFSVLGKRLGKDMGKVSNVVKKMTQEEILAFEKSGEISFFGHCLKLDDIKVVRQFKRPENVSEKEIDAAGDGDVLVILDLRADQSLFEAGVAREVVNRIQKLRKTAQLEPADPVDVYYESVGNDKNTLGEILKSQDQYIRGALGSPIVPKEIAPTDVVVLGEESHNVHDMSFVICIARSTPILSPDLLSHASGNSNHVEALRVYLLSRSLSRLKNDFQSGNGMITVDSIEGYPPISLQLGKHVFLSAGDFYLATRS

SEQ ID NO: 4627 - protein, 1172 aa, Zea mays
MDDVCEGKDFSFPEQEEGVIELWAKLDAFHEQLRRTEGGEEFVFYDGPPFATGLPHYGHILAGTIKDVVTRHQSMRGRHVSRRFGWDCHGLPVEFEIDKALGITNRQQVFDLGIGKYNETCRSIVTKYVSEWEAMVTRTGRWIDFKNDYKTMDLNFMESVWWVFAQLWEKDLVYRGFKVMPYSTGCKTALSNFEAALDYRTVPDPAVMVSFPIVGDADNAALVAWTTTPWTLPSNLALCVNANLTYAKVKDKSNGAVYVIAESRLGQLPVKAKASGKKQAPSKGSNIEAVQDGLDKESYELLSKIPGVSLVGLKYTPLFDFFIELQGTAFRVIADNYVTDDSGTGVVHCAPAFGEDDHRVCLAAGIFETAGLVVAVDDDGCFIEKISDFKGRYVKEADKDIINAVKDKGRLISKGSIEHSYPFCWRSGTPLIYRAVPSWFVKVEKIKDQLLECNKETYWVPDYVKEKRFHNWLEGARDWAVSRSRFWGTPLPLWISQDGEEIVVMDSIEKLEKLSGVKVTDLHRHYVDDITIPSKRGPEFGVLKRVDDVFDCWFESGSMPYAYIHYPFENRELFEKNFPGNFVAEGLDQTRGWFYTLMVLSTALFGKPAFKNLICNGLVLAEDGKKMSKSKKNYPPPKDLIDEFGADALRLYLVNSPVVRAESLRFKRTGVFAVVKDVFLPWYNAYRFFVQNAKRLEVEGLASFSPMEQVVLLKSSNVLDHWINSATESLVSFVHQEMDAYRLYTVVPYLVKYIDYLTNIYVRLNRKRFKGRTGEEDCRISLSTLYHVLVTTCVVMAPFTPFFTEVLYQNLRKVSSNSEESIHFCKFPSTTGERDERVEQSVKRMVTIIDLARNIRERHNKALKTPLKEMVVVHPDNDFLEDITGKLKEYVMEEINVKNVTPCNDPLMYASLRAEPNFSVLGKRLGKDMGKVSNVVKKMTQEQILAFEKSGEVSFFGHCLKLDDIKVVRQFKRPENVSEKEIDAAGDGDVLVILDLRTDQSLFEAGVAREVVNRIQKLRKTAQLEPADPVDVYYESVGNDKNTLEEILKSQDQYIRDALGSPIVPKEMAPTDVVVLGEESHNVHDMSFVICIARSTPIISPDLLSHASGNSNHVEALRVYLLSKSLSRLKNQFQSGNGVITVDCIEGYPLIRLQLGKHVFLSAGDFYLASRS

SEQ ID NO: 4628 - protein, 1170 aa, Zea mays
MDDVCEGKDFSFPEQEERVLELWAKLDAFHEQLRRTEGGEEFVFYDGPPFATGLPHYGHILAGTIKDVVTRHQSMRGRHVSRRFGWDCHGLPVEFEIDKLLGITNRQQVFDLGIGKYNETCRSIVTKYVSEWEAMVTRTGRWIDFKNDYKTMDLNFMESVWWVFAQLWEKDLVYKGFKVMPYSTGCKTALSNFEAALDYRTVPDPAVMVSFPIVGDMDNAAFVAWTTTPWTLPSNLALCINANLMYAKVRDKSNGKVYVIAESRLGQLPVKAKASGKKQAPSKGSNAEAAQDGLDKESYELLVKIPGPYLVGLKYTPLFDFFIELQETAFRVIADNYVTDDSGTGVVHCAPAFGEDDHRVCLAAGIFETAGLVVAVDDDGCFIEKISDFKGRYVKEADKDIISADKGRLVSKGSIEHSYPFCWRSGTPLIYRAVPSWFVKVEKIKDQLLECNKETYWVPDYVKEKRFHNWLEGARDWAISRSRFWGTPLPLWMSQDRKEIVVMDSIEKLEKLSGVKVTDLHRHYVDDITIPSKRGPKFGTLKRVDDVFDCWFESGSMPYAYIHYPFENRELFEKNFPGNFVAEGLDQTRGWFYTLMVLSTALFGKPAFKNLICNGLVLAEDGKKMSKSKKNYPSPKDLIDEFGADSLRLYLVNSPVVRAESLRFKRTGVFAVVKDVFLPWYNAYRFFVQNAKRLEVEGLASFSPMEQAVLLKSSNVLDHWINSATESLVSFVHQEMDAYRLYTVVPYLVKYIDYLTNIYVRLNRKRFKGRTGEEDCRISLSTLYHVLVTTCVVMAPFTPFFTEVLYQNLRKVSSKSEESIHFCKFPSTTGERDERVEQSVNRMVTIIDLARNIRERHNKALKTPLKEMVVVHPDNDFLEDITGKLKEYVMEEINVKTVTPCNDPLMYASLRAEPNFSVLGKRLGKDMGKVSNVVKKMTQEQILDFEKSGEISFFGHCLKLDDIKVVRQFKRPENVSEKEIDAAGDGDVLVILDLRADQSLFEAGVAREVVNRIQKLRKTAQLEPADPVDVYYESVGSDKNTLEEILKSQDQYIRDALGSPIMPKEMAPTDDVILGEESHNVHDMSFVICIARSTPILAPDLLSHASGKSNHVEALRVYLLSRSLSRLKNQFQAGKGMITVDCIEGYPPVSLLLGKHVFLSAGDFYLASRS

SEQ ID NO: 4629 - protein, 884 aa, Zea mays
MFGDCQVLSSMAAVAGASSSADTLFIPNPGALAGFMSSSSAAAAMPFHHFSTTAASLVPKEEGGIMGALQVAKDEDMDQLEMEMELSGGSGSGHLDGLLSFADVDDDRPEQKPQHSGLELQTTADAAGQQQQLATANGKKKRYHRHTAHQIQQMEALFKECPHPDDKQRLKLSQELGLKPRQVKFWFQNRRTQMKAQQDRADNVLLRAENESLKSDNYRLQAAIRNVVCPNCGHAAVLGEMSYEEQQLRIENARLKDELDRLACIATRYGGGRQPSMSSSALVCLSAPPPVLMPPLDLDMNVYSRHFTDQSPVMGCGDLIQSVLGPPSQQITGGAEHHASTPSFMGAMAPVQEQDRQLVLDLAAAAADTLAKMCRAGESLWLRRRGASSEVMVADEHARMFSWPVNGGQQDSSASPGGAAARTEGSRDGTVVIMNSITLVDAFLDANKWMELFPSIVSKARTIQIINHGAASGHMGSGSLLLMQAELQFPSPLVPAREVVFFRYCVHNGDEGTWSLVDFPAEGFQLEALQTPSVVRCCRRPSGCIIQDMPNGYSSVVWVEHTEIVGEEKPLHQVFKDYVASGSAFGATRWVSLLQRQCERLASELARNIADLGVIRTPEARTNMMKLSQRMITSFSANISASGSQSWTSLSETTEDTIRVTTRKNTDPGQPSGVILTAVSTSWLPFNHQKVFELLADEQQRCQLEIMSSGGSLHEVAHIANGSHPKNCISLLRINAASNSSQNVELMLQESSTHPDGGSLVVFATVDVDAIQVTMSGEDPSYIPLLPLGFAIFPAANPSAAATSAAGSGDGQSSPAGNADEPASGCLLTVGMQVLASAVPSAKLNLSSVTAINSHVCNAVHQITAALKGAGASGAAEPAAAASE

SEQ ID NO: 4630 - protein, 884 aa, Zea mays
MFGDCQVLSSMAAVAGASSSADTLFIPNPGALAGFMSSSSAAAAMPFHHFSTTAASLVPKEEGGIMGALQVAKDEDMDQLEMEMELSGGSGSGHLDGLLSFADVDDDRPEQKPQHSGLELQTTADAAGQQQQLATANGKKKRYHRHTAHQIQQMEALFKECPHPDDKQRLKLSQELGLKPRQVKFWFQNRRTQMKAQQDRADNVLLRAENESLKSDNYRLQAAIRNVVCPNCGHAAVLGEMSYEEQQLRIENARLKDELDRLACIATRYGGGRQPSMSSSALVCLSAPPPVLMPPLDLDMNVYSRHFTDQSPVMGCGDLIQSVLGPPSQQITGGAEHHASTPSFMGAMAPVQEQDRQLVLDLAAAAADTLAKMCRAGESLWLRRRGASSEVMVADEHARMFSWPVNGGQQDSSASPGGAAARTEGSRDGTVVIMNSITLVDAFLDANKWMELFPSILSKARTIQVINHGSASGHMGSGSLLLMQAELQFPSPLVPAREVVFFRYCVHNGDEGTWSIVDFPAEGFQLEALQTPSVVRCCRRPSGCIIQDMPNGYSSVVWVEHTEIVGEEKPLHQVFKDYVASGSAFGATRWVSLLQRQCERLASELARNIADLGVIRTPEARTNMMKLSQRMITSFSANISASGSQSWTSLSETTEDTIRVTTRKNTDPGQPSGVILTAVSTSWLPFNHQKVFELLADEQQRCQLEIMSSGGSLHEVAHIANGSHPKNCISLLRINAASNSSQNVELMLQESSTHPDGGSLVVFATVDVDAIQVTMSGEDPSYIPLLPLGFAIFPAANPSAAATSAAGSGDGQSSPAGNADEPASGCLLTVGMQVLASAVPSAKLNLSSVTAINSHVCNAVHQITAALKGAGASGAAEPAAAASE

SEQ ID NO: 4631 - protein, 179 aa, Zea mays
MAAAAEGKSRRFALACGVLSQYVKAEQQMAAAGAPAPRAPATTLSLMPGADVGAEQEQAAARGQETAGSASTAAPLTIFYGGRVVVFDDFPAEKAAEVMRLAAGAERPAAPAPAPAPRDDLPIARKASLQRFLAKRKDRLVERAPYARPSPSEEAEKAKPASSWLGLGGTDAERLNIAL

SEQ ID NO: 4632 - protein, 186 aa, Pennisetum glaucum
MAAAEGKSRRFALACGVLSQYVKAEQKMAAVAPRAPATTLSLMPGADVGAEQEPAASAAARGAEDAAGPASTAAAPLTIFYGGRVVVFEDFPAEKAAEVMRLAAGAGGGAGPERVAAPAPAPRDDLPIARKASLQRFLAKRKDRLVERAPYTRPSPAAEEAEKTKKPAAWLGLGSADAERLTTIAL

SEQ ID NO: 4633 - protein, 178 aa, Panicum virgatum
MAAAEGKSRRFALACGVLSQYVKAEQMMAVAPAPGPRAPATTLSLMPGADVGAEQEPTAAARGEEAAGPASASTAAPLTIFYGGRVVVFEDFPAEKAAEVMRLAAGTERAAAPAPAPRDDMPIARKASLQRFLAKRKDRLVERAPYTRPSPAEEAEKKKPAAWLGLGSADADRLAIAL

SEQ ID NO: 4634 - protein, 1074 aa, Zea mays
MPAAAVPGGGGAADAEELFRTKRIPEIRAAEGATRREISAKEEELRQLVGRSYRDLLDSADSILLIKQSSDAISDNLARISGSLSSLSPPHEPSPAVSAASPSPSAGGRARLYALAARAKYLVDTPEHIWGRLDEGLLLEAAGRYLRAQVVHGRLSRDATAAARFPLLAHQAQLVEAFRPQISQRARERLADRRLPVAAHADALAAVAAIDSPSLAPAQALLLFLTSRRAWISQALAGLASDLSSYTSVLCDIARIVRITLGHVGQLFVPALSDMPLFFKTVLEKTPPEQLFGGIPDPDDEARLWKEHMNQLEATMVLLEADAIAGACTDWLKECCTKIFGVIAGEQKLVDAIGSGELLGSVQRLVREALDGRDGLEGSLEQWLKSVFGSDIESPWDQIHGLILKDGKDIFEDWMEEAFVRRMKDIVHSELDRLGASVNVKELVHAIGANADPKDAGDFLAYLRKSSKGGGFWFSESKIKKGGVLAHLKPIADENDFHSCLTLYFGPEVSRIRSAIDSKCKNILDDLLSFVESHNSAPRLKELVPYLQEKCYRTISGVLKELEAELRKLSALLGTKKEGNDIPAASIIAERSLFIGRILFALRYYSSHVPLILGSPREWVEEAGGAAFARLSSPTPRHSRASFDSLVPFTSRRRTFDSPKSPGRQFSDSPRRQTIAAAVSLFGADDRSNPRLDELNKTMQSLCIMAHNVWITWVSTELSHILSYDISKDDSLSSSTPLRGWEVTVIKQDETTEGPLEMQIALPSMPSLYIISFLYQACLEIHKVGGHILYRIILHNFAWELLQKVVNIYEKFLSCVESGNSTVSEKGILQILLDLRFVGDVLSGGKSSSTNSPEMQTKQDFLPSAVTKTSFRRKQSQLQADSAVIEPINKLVNRLSQRLDPIDWATYEPYLWENEKQSYKRYVVLFGFLVQLNHKYTSTVQKLPTKSNTDSNIMRCSQVPRFKYLPISAPVISSRSHKSSLQSPSSDSTSKNTWKSYSNGDGSSTPDFDDNASLVGAAPLLKSFVTQVGSKFGENTSRWGSMLSDGQVGKLSDILPGPAAGFFSSFTSGARYDS

SEQ ID NO: 4635 - protein, 1074 aa, Zea mays
MPAAAVPGGGGAADAEELFRTKRIPEIRAAEGATRREISAKEEELRQLVGRSYRDLLDSADSILLIKQSSDVISDNLARISGSLSSLSPPHEPSPAVSAASPSPSAGGRARLYSLAARAKYLVDTPEHIWGRLDEGLLLEAAGRYLRAQVVHGRLSRDATAAARFPLLAHQAQLVEAFRPQISQRARERLADRRLPVAAHADALAAVAAIDSPSLAPAQALLLFLTSRRAWISQALAGLASDLSSYTSVLCDIARIVRITLGHVGQLFVPALSDMPLFFKTVLEKTPPEQLFGGIPDPDDEARLWKEHMNQLEATMVLLEADAIAGACTDWLKECCTKIFGVIAGEQKLVDAIGSGELLGSVQRLVREALDGRDGLEGSLEQWLKSVFGSDIESPWDQIHGLILKDGKDIFEDWMEEAFVRRMKDIVHSELDRLGASVNVKELVHAIGANADPKDAGDFLAYLRKSSKGGGFWFSESKIKKGGVLAHLKPIADENDFHSCLTLYFGPEVSRIRSAIDSKCKNILDDLLSFVESHNSAPRLKELVPYLQEKCYRTISGVLKELEAELRKLSALLGTKKEGNDIPAASIIAERSLFIGRILFALRYYSSHVPLILGSPREWVKEAGGAAFARLSSPTPRHSRASFDSLVPFTSRRRTFDSPKSPGRQFSDSPRRQTIAAAVSLFGADDRSNPRLDELNKTMQSLCIMAHNVWITWVSTELSHILSYDISKDDSLSSSTPLRGWEVTVIKQDETTEGPLEMQIALPSMPSLYIISFLYQACLEIHKVGGHILYRIILHNFAWELLQKVVNIYEKFLSCVESGNSTVSEKGILQILLDLRFVGDVLSGGKSSSTNSPEMQTKQDFLPSAVTKTSFRRKQSQLQADSAVIEPINKLVNRLSQRLDPIDWATYEPYLWENEKQSYKRYVVLFGFLVQLNHKYTSTVQKLPTKSNTDSNIMRCSQVPRFKYLPISAPVISSRSHKSSLQSPSSDSTSKNTWKSYSNGDGSSTPDFDDNASLVGAAPLLKSFVTQVGSKFGENTSRWGSMLSDGQVGKLSDILPGPAAGFFSSFTSGARYDS

SEQ ID NO: 4636 - protein, 1068 aa, Zea mays
MPAVPVPGGGGSSDAEELFRTKRIPEIRAVEGATRREISAKEEELRQLVGRSYRDLLDSADSILLIKQSSDAIFYNLARISDSLSSLSPPPEPSLAVSAVSPSPSAGGRARLYALAARAKYLVDTPEHIWGRLDEGLLLEAAGRYLRAQVVYGRLSRDAAAAARFPLLAHQAQLVEAFRPQIAQRARERLADRRLPVAAHADALAAVAAIDAPSLAPAPALLLFLTSRRAWISQDLAGLASDLSSYTSVLCDIARIVRITLGHVGQLFVPALSDMPLFFKTVTEKTPPEQLFGGIPDPDDEARLWKEHMNQLEAIMVLLKPDVVAAACTDWLKECCSEIFGVIAGEQKLVDAIGSGELLGSVQRLVRDALDGRDGLERSLEQWLKSVFGSDTESPWDQIRGLILKDDKDIFEDWMEEAFVRRMKDIVHSEFDILGSSVNVKESIHAIGANADPKDAGDFLAYLRKSSKGGGFWFSESKIKKGGVLAHLKPIADENDFRSCLTSYFGPEVSRIRSAIDSKCKNILEDLLSFVESHNSTTRLKELVPYLQEKCYKTISGVLKELEAELRKLSALLGTKKEGNDIPAASIIAERSLFIGRLLFALRYHSSHVPLILGSPREWVKEVGGAAFARLSSPTARHLRASFTPRRHTFDSPKSPGRQFSDSPRRQTIAAAVSLFGANDRSNPRLDELNKTLQSLCIMAHNVWIAWVSTELSHILSYDLNKDDSLSSATPLRGWEVTVIKQEETTEGPLEMQIALPSMPSLYIISFLYQACLEIHKVGGHILDRIILHNFAWELLQKVINIYENFLSSVESGNSPVSEKGILQILLDLRFIGDVLSGGTSSSTNTTEMQTKQDSLPSTISKTSFRRKQSQLHADSAVIEPINKLVNRLSQILDPIDWATYEPYLWENEKQSYKRHVVLFGFLVQLNHMYTGTMQKLPTKSNTDSNIMRCSQVPRFKYLPISAPAISSRSHKPSLQSLSSESTSKNPWKSYSNGDRSTTPEFDDNASLVGAAPLLKSFVTQVGTKFGENTSRWGSMLSDGQVGKLSDILPGPAAGFFSSFTSGARYDS

SEQ ID NO: 4637 - protein, 773 aa, Setaria italica
MPLFFKTVLEKTPPEQLFGGLPDPDEESQFWKEHMNQLEATMVLLEPDVIACACTDWLKECCAEIFGVIAAGQKLVDAIGSGELLGSVQRLVRDALDGRDGLEGSLEQWLKSVFGSEIESPWDQIRGLILKGGKDIFEDWMEEAFVRRMKDILHSDLDSLCASVNVKESIDAIGANADPKDAGDSYLRKSSNGGGFWFSESKIKKGGVLAHLKPIADENDFHSCLTSYFGPEVSRIRNAIDSKCKSILDDLLCFVESHNSAPRLKELVPYLQEKCYRTISGVLKELETELRKLSALLGTKKEDNDIPAASIIAERALFIGRLLFALRYHSSHVPLILGSPREWVKEAGGAAFARLSSPTPRHSRASFDSSSFTPRRRTFDSPRSPGMQFSDSPRRQTIAAAISLFGAEDRSNPRLDELNKTLQSLCIMAHSVWIAWVSTELSHILSYDLNKDDSLSSSTPLRGWEVTVIKQEETTEGPLEMKIALPSMPSFYIISFLYQACLEIHKVGGHILDRIILHNFAWELLQKVINIYENFLVSIESGNSQVSEKGVLQILLDLRFVGDVLSGGKNSSTITTETQTKQDSLPSTISKSSFRRKQSQSQADSAAIEPINKLINKLSQRLDPIDWATYEPYLWENEKQSYKRYVVLFGFLVQLNHMYTGTVQKLPTKSNTDSNIMRCSQVPRFKYLPISAPAISSRPHKTSLQSPSGDNASKGPWKSYSNGDRSTAPEFDDNASLVGAAPLFKSFVTQVGSKFGENTSRWGSMLSDGQVGK

SEQ ID NO: 4638 - protein, 1069 aa, Oryza sativa
MPAAAVSGGGAADAEELFRTRRIPEIRAAEGATRREISAKEEELRQLVGRSYRDLLDSADSILLIKQSSDAVSGNLSRISDSLASLAPPPEAPPAASPSPSGGRVRLYASAARAKYLVDTPEHIWGRLDEGLLLEAAGRYVRAQVVHGVLSRDAAAAARFPLLAHQAQLVEAFRPQIAQRARERLADRRLSVAAHADALAAAASIDAPSLTPTQALQLFLSSRRAWISQALTTLASDLTSYSSVLCDVAKIVRVTLGHVGQLFVLALNDLPLFFKTVLDLPPPSQLFGGIPDPVEETRLWKEHWDQLEATMVLLEPDAVARTCTDWLKGCCDEIFGVIAGGQRLVDAIESGEGLGSVQRLVREALDGREGLEGTLEQWLKSVFGSEIESPWDQIRGLILKEGKDIFEDWMEEAFVQRMKDIVHLEFGSLDDSVNIKKSIDGIGANADPKDAGDFMVYLRKVSTGGGVWFSESKIKKGGILAHLKPIADENDFHSCLTSYFGPEVSRIRNAIDSKCKTILEDLLSFVDSHNSAPRLKELVPYLQEKCYKTISGILNGLEAELGKLSASLRTKKGESNMLAASVIVERSLFIGRLMFALRYHSSHVPLILGSPRQWVKEAGGAAFMRLSSPSPRHSRASFDTAMPFTPRRHTQSSPRSPGRQFSDNPRRQTIAAAASLFGADDSSNPRLDELNKTLQALCIAAHGLWIAWLSTELSQLLSYDLNKDDSLSLSTPLRGWEVTVIKQEESTEGPLEMQIALPSMPSLYIISFLYQACLEIHKIGGHILDKSILQNFAWDLLQKVIDIYESFLVSIESGKSLVSEKGVLQILLDLRFIGDVLSGGKSSSTKTTETQRTHDSSPSAIAKTSFRRKQSQLQADSATIEPINKLINKFSQRLDPIDWATYEPYLWENEKQSYKRYVVLFGFLVQLNHMYTGTVQKLPTKSNTDSNIMRCSQVPRFKYLPISAPALSSRAHKSSLQSTSDDSTSRSPWKSYSNGERSTASEFDDNVSLGGAAPLLKSFVTQVGSKFGENTSRWGSIISDGQVGKLSDILPGPAAGFFSSFTSGARYDP

SEQ ID NO: 4639 - protein, 1033 aa, Brachypodium distachyon
MPAAAASGGGVADAEDLFRTKRIAEIRAAESATRREISAKEEELRQLVGRSYRDLLDSADSILLIKQSSDSISDNLSRVSESLSSLSPPPEAPSASANAASPSPSGGRARLYAAAARAKYLVDTPEHIWGRLDEGMLLEAAGRYMRAQVVHRLLSRDAAAAARFPLLAHQAQLVEAFRPQIAQRARERLADRRLSSALASDPSSYTSVLCDVARIVRVTLGHVGQLFVPALTDLPLFYKTVLESPPPAQLFGGIPDPDEETRLWREHWDRLEATMVLLETEAVARTCTDWLKECCDEIFGVIAGAQRLVDAIESGEGLGSVQKLMREALDERKGLEGSLEQWLKSVFGSEIESPWDQIRGLILKEGKDIFEDWVEEAFVRRMKDIVHSEFDSLGGSVNVMESMEAIGANADPKDAGDFLLYMRKASTGGSVWFSESKIKKGGILAHLKPIADENDFHSCLTSYFGPEVSRIKNAIDNKCKSILEDLLSFVESHNSVPRLKELVPYLQEKCYRTISEILNKLEAELGKLSASLGTQRKDNSIPAAPIIVERSLFIGRLLFALRYHSSHVPLILSSPRQWLKDSGGAAFARLSSPTPRHSRTSFDSSMPFAPRRHTLDSPSSPGRQFSDSPRRPIASAAASLFGADDSSNPRLDELNKTLKALCITAHTLWITWVSTELSDLLSYALNSDDSLSSSTALRGWEVTVIKQEQPTDGPLEMQIALPSMPSLYIISFLYQACLEIHKIGGHVLDKIILHNFAWDLLQKVIKIYKNFLVSIELGNSQVSEKGVLQILLDLRFIGDVLSGGKNSSSNPSETQIKQDSSPSTMAKTSFRRKQSQFQADSATIEQTNKLIDQFSQRLDPIDWATYESYLWENEKQSYKRCVVLFGFLVQLNHMYTGTVQKLPTKSNTDSNIMRCSQIPRFKYLPISAPALSSRTPKSSLQSPSDDSTSRSPWKSYSNGERSTSSEYDNDASLGSAAPLLKSFVTQVGSKFGENTSRWGSMLSDGQVGKLSDILPGPAAGFFSSFTSGVRYDS

SEQ ID NO: 4640 - protein, 481 aa, Zea mays
MGSTGREPEVTRANFPDGFVFGVATSAYQIEGARREGGKGDNIWDVFTDDKERVLDRSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQSGEVGLVVDCEWAEPFSEKLEDQIAAQRRIDFQLGWYLDPIYFGDYPESMRQRLGSDLPTFSEKDKKFIKNKIDFIGLNHYTSRLIAHHQNPDDVYFYKVQQMERVEKWSSGESIGERAASEWLVIVPWGLHKLLNYIVKKYNNPVIYVTENGMDDEDDQSATIDQVLNDTKRVGYFKGYLNSVAQAIKDGADVRGYFAWSFLDNFEWAMGYTKRFGIVYVDYKDGLSRHPKASALWFSRLLKGEAAENSYS

SEQ ID NO: 4641 - protein, 481 aa, Zea mays
MGSTGREPEVTRANFPDGFVFGVATSAYQIEGARREGGKGDNIWDVFTDDKERVLDRSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQSGEVGLVVDCEWAEPFSEKLEDQIAAQRRIDFQLGWYLDPIYFGDYPESMRQRLGSDLPTFSEKDKKFIKNKIDFIGLNHYTSRLIAHHQNPDDVYFYKVQQMERVEKWSSGESIGERAASEWLVIVPWGLHKLLNYIVKKYNSPVIYVTENGMDDEDDQSATIDQVLNDTKRVGYFKGYLNSVAQAIKDGADVRGYFAWSFLDNFEWAMGYTKRFGIVYVDYKDGLSRHPKASALWFSRLLKGEAAENSYS

SEQ ID NO: 4642 - protein, 480 aa, Zea mays
MGSTGREPEVTRADFPDGFVFGVATSAYQIEGARREGGKGDSIWDVFTDDKEHVLDRSNGEIAVDHYHRYKEDIELMASLGFSAYRFSISWARIFPDGLGGNVNDQGVAFYNDLINFMISKGIEPYATLYHWDLPNNLQKTLGGWISDKIVEYFALYAEACFANFGDRVKHWITINEPLQTAINGYGIGIFAPGGCQGETARCYLAAHHQILAHAAAVDVYRRKFKAAQGGEVGLVVDCEWAEPFSENVEDQIAAQRRLDFQLGWYLDPIYFGDYPESMRQRLGSDLPTFSEKDKEFMRNKIDFVGVNHYTSRLIAHLQNPNDVYFYQVQQMERIEKWNSGEKIGERAASEWLFIVPWGLHKSLNYIAKKYNNPAIYVTENGMDEEDDQSATLDQVLNDTTRVGYFKGYLNSVAQAIKDGADVRGYFAWSFLDNFEWAMGYTKRFGIVYVDYKNGLSRHPKASALWFSRLLKGEAGTGTS

SEQ ID NO: 4643 - protein, 480 aa, Zea mays
MGSTGREPEVTRADFPDGFVFGVATSAYQIEGARREGGKGDSIWDVFTDDKEHVLDRSNGEIAVDHYHRYKEDIELMASLGFSAYRFSISWARIFPDGLGGNVNDQGVAFYNDLINFMISKGIEPYATLYHWDLPNNLQKTLGGWISDKIVEYFALYAEACFANFGDRVKHWITINEPLQTAINGYGIGIFAPGGCQGETARCYLAAHHQILAHAAAVDVYRRKFKVAQGGEVGLVVDCEWAEPFSENVEDQIAAQRRLDFQLGWYLDPIYFGDYPESMRQRLGSDLPTFSEKDKEFMRNKIDFVGVNHYTSRLIAHLQNPNDVYFYQVQQMERIEKWNSGEKIGERAASEWLFIVPWGLHKSLNYIAKKYNNPAIYVTENGMDEEDDQSATLDQVLNDTTRVGYFKGYLNSVAQAIKDGADVRGYFAWSFLDNFEWAMGYTKRFGIVYVDYKNGLSRHPKASALWFSRLLRGEAGTGTS

SEQ ID NO: 4644 - protein, 483 aa, Panicum virgatum
MGSTGREAEVARADFPDGFVFGVATSAYQIEGARREGGKGDNIWDVFTEDKERVLDRSNGDIAVDHYHRYREDIELMASLGFRAYRFSISWARIFPDGMGGKVNEQGVAFYNNLINFMIAKGVEPYATLYHWDLPNNLQKTLGGWISEKIVDYFALYAEACFANFGDRVKRWMTINEPLQTAFNGYGIGVFAPGGCEGETARCYLAAHHQILAHAAAVDVYRRKFKAAQGGEVGLVVDCEWAEPFSEKAEDQIAAQRRIDFQFGWFLDPIYFGDYPESMRERLGSDLPTFSEKEKEFIRNKIDFIGLNHYTSRLIAHRQNPEDVYFYQVQQVERIEKWNSGEKIGERAASEWLFIVPWGLHKLLNYIAKKYDNPAIYITENGMDEEDDQSATLEQVLNDTTRVGYFKGYLASVAQAIKDGVDVRGYFAWSFLDNFEWAMGYTKRFGIVYVDYKNGLSRHPKASALWFSRFLKGEAAENKADTN

SEQ ID NO: 4645 - protein, 483 aa, Pennisetum glaucum
MGSTGSEAEVSRADFPDRFIFGVATSAYQIEGARREGGKGDSIWDVFTEDKERILDGSNGDVAVDHYHRYKEDIELMASLGFGAYRFSISWARIFPDGLGEKVNEQGVAFYNDLINFMIAKGIEPYATLYHWDLPNNLQKTIGGWISDKIVDYFALYAEACFANFGDRVKRWITINEPLQTAVNAYGIGVFAPGGCQGETARCYLAAHHQILAHAAAVDVYRRKFKAAQGGEVGLVVDCEWAEPFSDKVEDQIAAQRRIDFQLGWYLDPIYFGDYPESMRQRLGSDLPTFSETDKEFIRNKIDFVGLNHYTSRFIAHHQNPKDIYFYQVQQVERLEKWNSGEKIGERAASEWLFIVPWGLHKLLNYIAKKYNNPAIYVTENGMDEEDDQSVTLEQALNDTTRVGYFKGYLASVAQAIKDGVDVRAYFAWSFLDNFEWAMGYTKRFGIVYVDYKNGLSRHPKASALWFSRFLKGESAENKADTN

SEQ ID NO: 4646 - protein, 483 aa, Panicum virgatum
MGSTGREAEVARADFPDGFVFGVATSAYQIEGARREGGKGDNIWDVFTEDKERVLDRSNGDIAVDHYHRYREDIELMASLGFRAYRFSISWARIFPDGLGGKVNEQGVAFYNNLINFMIAKGIEPYATLYHWDLPNNLQKTLGGWISEKIVDYFALYAEACFANFGDRVKRWITINEPLQTSVNAYGIGVFAPGGCEGETARCYLAAHHQILAHAAAVDVYRRKFKAAQGGEVGLVVDCEWAEPFSEKAEDQIAAQRRIDFQLGWYLDPIYLGDYPESMRERVGNDLPTFSEKDKEFIRNKIDFVGLNHYTSRLIAHHQNPGDIYFYQVQQVERIEKWNTGQKIGERAASEWLFIVPWGLHKLLNYIAKKYDNPPIYITENGMDEEDDQSATLEQALNDTTRVGYFKGYLASVAQAIKDGVDVRGYFAWSFLDNFEWAMGYTKRFGIVYVDYKNGLARHPKASALWFSHFLKGEAAENKADTN

SEQ ID NO: 4647 - protein, 444 aa, Pennisetum glaucum
GDSIWDVFTEDKERILDGSNGDVAVDHYHRYKEDIELMASLGFGAYRFSISWARIFPDGLGEKVNEQGVAFYNDLINFMIAKGIEPYATLYHWDLPNNLQKTIGGWISDKIVDYFALYAEACFANFGDRVKRWITINEPLQTAVNAYGIGVFAPGGCQGETARCYLAAHHQILAHAAAVDVYRRKFKAAQGGEVGLVVDCEWAEPFSDKVEDQIAAQRRIDFQLGWYLDPIYFGDYPESMRQRLGSDLPTFSETDKEFIRNKIDFVGLNHYTSRFIAHHQNPKDIYFYQVQQVERLEKWNSGEKIGERAASEWLFIVPWGLHKLLNYIAKKYNNPAIYVTENGMDEEDDQSVTLEQALNDTTRVGYFKGYLASVAQAIKDGVDVRAYFAWSFLDNFEWAMGYTKRFGIVYVDYKNGLSRHPKASALWFSRFLKGESAENKADTN

SEQ ID NO: 4648 - protein, 483 aa, Hordeum vulgare
MGSTAGEVTRADFPEGFVFGVATSAYQIEGGRNEGGKGDSIWDVFTDNKERVLDGSSGEVAVDHYHRYKEDIELMAKLGFGAYRFSISWSRIFPDGLGTEINEQGVAFYNNLIDFMIEKGIQPYATLYHWDLPHNLQRTMGGWLSDKIVEYFALYAEACFANFGDRVKHWITINEPIQTCINAYGIGIFAPGLCKGVSAEPFLAGHHQILAHAAAVDVYRRKFKAKQGGQVGFVIDCEWAEPMSDKMEDQAAAARRIDFQLGWFLDPIYFGDYPESMRQRVGEHLPKFSEKDRELMRNKIDFIGLNHYTSRIIGHQPNPQPEEIHFYQVQQIDRTDKWSSGEAVGERAASEWLLIVPWGIRKTINYIVKKYENPIIYITENGMDDEDDPSAPVDQFLNDTRRVNFFKGYVGGVAQAIKDGADVRGYFAWSFLDNFEWAMGFTKRFGIVYVDYKNGLSRHPKASAMWFSRFLNGEAPDSKPDTN

SEQ ID NO: 4649 - protein, 483 aa, Triticum aestivum
MGSTAGEVTRADFPEGFVFGVATSAYQIEGARNEGGKGDSIWDVFTDNKERVLDGSSGEVAVDHYHRYKEDIELMAKLGFGAYRFSISWSRIFPDGLGTEINEQGVAFYNNLIDFMIEKGIQPYATLYHWDLPHNLQKTMGGWLSDKIVEYFALYAEACFANFGDRVKHWITINEPIQTCINAYGVGIFAPGLCKGVAAEPFLAGHHQILAHAAAVDVYRRKFKAKQGGQVGFVIDCEWAEPKSDKMEDQAAAARRIDFQLGWFLDPIYFGDYPESMRQRVGEYLPKFSEKDRELMRNKIDFIGLNHYTSRIIGNQPNPQPQEIHFYQVQQIERTDKWSSGEAIGERAASEWLLIVPWGIRKTINYIVKKYENPIIYVTENGMDDEDDPSAPVDQFLNDTKRVNFFKGYVGAVAQAIKDGADVRGYFAWSFLDNFEWAMGFTKRFGIVYVDYKNGLTRHPKASAMWFSRFLNGETADSKPDTN

SEQ ID NO: 4650 - protein, 275 aa, Saccharum officinarum
MADHQRIHPVDLEAGSNRPTAPLVPGGSFRSDKGDPARSANQQQQQQQQRAYVPGGPLPPPPRRVAPEAPLPPPRKRRGGRGCCCRFLCCVVITAVVLAVLAAAAAGALYLALDPKAPRYSVDRLSVSAFQVDPSTLTARAGFDVTVTAANPNSRIGIQYEPGSSLGVWYQSYRLARGALPAFYQGHRNTTVLALAMAGEVQLGTAVVSGLQDAQRTGAVPLVFRADVPVRVEIGSFKLWKVTSRVRCDLVVDRLMDVSSPIKIKASNCKFSLKL

SEQ ID NO: 4651 - protein, 276 aa, Saccharum officinarum
MADHQRIHPVDLEAGSNRPTAPLVPGGSFRSDKGDPARSANHQQQQQQQQRAYVPGGPLPPPPRRVAPAAPLPPPRKRRGGRGCCCRFLCCVVITAVVLAVLAAAAAGALYLALDPKAPRYSVDRLSVSAFQVDPSTLTARAGFDVTVTAANPNSRIGIQYEPGSSLGVWYQSYRLARGALPAFYQGHRNTTVLALAMAGEVQLGTAVVSGLQDAQRTGAVPLVFRADVPVRVEIGSFKLWKVTSRVRCDLVVDRLMDVSSPIKIKASNCKFGLKL

SEQ ID NO: 4652 - protein, 255 aa, Saccharum officinarum
  misc_feature (126)..(126): Xaa can be any naturally occurring amino acid
  misc_feature (136)..(136): Xaa can be any naturally occurring amino acid
  misc_feature (157)..(157): Xaa can be any naturally occurring amino acid
  misc_feature (164)..(164): Xaa can be any naturally occurring amino acid
  misc_feature (167)..(167): Xaa can be any naturally occurring amino acid
  misc_feature (170)..(170): Xaa can be any naturally occurring amino acid
  misc_feature (177)..(177): Xaa can be any naturally occurring amino acid
  misc_feature (179)..(179): Xaa can be any naturally occurring amino acid
MADHQRIHPVDLEAGSNRPTAPLVPGGSFRSDKGDPARSANHHQQQRAYVPGGPLPPPPRRVAPAAPLPPPRKRRGGRGCCCRFLCCVVITAVVLAVLAAAAAGALYLALDPKAPRYSVDRLSVSXFQVDPSTLTXRAGFDVTVTAANPNSRIGIQXEPGSSLXVWXQSXRWRGARXRXLPGPPQHHGAGAGHGRGGAAGHRRRVRIAGRAADGRRAARVPRRRARARRDRQLQAVEGHVQGALRPRRRQAHGRQ

SEQ ID NO: 4653 - protein, 274 aa, Zea mays
MADHQRIHPVDLEAGNRPTTPLVPGGSFRSDKGDPAQRANNHHQQQQQRGYVYVPGPLPPPPRRAAPPAPPLPPPKRRGRGCCCRFLCCAVITAVVLAVLAAAAAGALYLLLDPKAPRYSVDRLSVSTFQVDPSTLTARAGFDVAVTAANPNSRIAIQYEPGSSLGVWYQSYRLARGALPPFYQGHRNTTVLALAMAGEVQLGGAAVAGMRDAQRTGAVPLVFRADVPVRVELGTFKLWKVTSRVRCDLVVDRLMDVSSPIKIKASNCKFGLKL

SEQ ID NO: 4654 - protein, 265 aa, Zea mays
MADHQRIHPADLEAGNRPLMPGGSFRSDKGDPAQRAKQQQQQGYVPGALPPPPRRVAPPAPLPPPKRRGRGCCCRLLCCAVISAAVLAVLAAAAAGALYLALDPKAPRYSVDRLSVSAFQVDPATLAARARFDVAVAATNPNSRIGIHYERGSSLGVWYQSYRLARGALPAFYQGHRNTTVLALAMAGEAQLGSAAVVSGMQDAQRTGAVPLVFRADVPVRVQLGTFKLWKVTARVRCDLVVDRLMDVTSLIKIKAGNCKFSLKL

SEQ ID NO: 4655 - protein, 279 aa, Pennisetum glaucum
MADHQRIHPVDLESGNNNRPTAPLVPGGSFRSDKGDPAAQRAVNPHHQYQQHHQQQQRGHGPLPPPPRRVGPPAPLPPPKRRGRRGCCCRLLCCAVVTLVLLAVLAAAAAGALYLILKPKAPRYSVDRLSVSAFQVDPSTLTARAAFDATVTAANPNSRIGIHYERGSSLSVWYESYRLARGALPTFYQGHRNTTVLALAMAGEVQLGSAVVSGLRDAQQAGAVPLVFRADVPVRVQLGAVKLWKVTSRVRCDLVVDRLMDLSTPIKIKASNCKFSLKL

SEQ ID NO: 4656 - protein, 469 aa, Zea mays
MDASSVSPCDLDREFALQIAQLLATPPLQSAQEYYGELIRSKKLDGIRVSYSGKHGKGVYANRDFGEDDLVLKDQMLVGAQDSLNKIDCVVCSYCFHFIGSIEYQIGRRLYLQSLGGSGDGTTERHCHGSDVGSSTGCSGASNGNSNAVPQEVLLSLMDGNTLLPLTDQFCLPPVVACPGGCEGELYCSQSCADSDWDSYHSLLCAGSKTEPLRKSALQKFVGHANETNDIFLVAAKAITFTLLRYRKLKRQHVSHESSSSLLLEAWKPLSMGFKKRWWECVALPEDVDSSEEELFRQQIRDLAFTSLQLLKDAIFDPECAPLFSLDIYGHIIGMFELNNLDLVVASPVEDYFIYIDGLPESDKEEAEKVTGPFLDALGEDYLVPCEGTAFFPLQSCMNHSCRPNAKAFKRDEDKDGHAVIIALRPISKDEEITIAYIDEDLPYEERQAQLADYGFTCTCLKCQEERPV

SEQ ID NO: 4657 - protein, 690 aa, Saccharum officinarum
MGARDNGEGRDEKKGTGSDYVPTRDPFSSQGESRVPKKLGKKETKDNSPRMTKSSAGRLAQNKLQHKGLNNVQNKSQKQKKTISAAKAVEVRKPDIARIPSRAPSELSEETDDIISDAGTVDDKGTEEAKEIDVLDEAPHCDQSTGTDDETPDIEDKVVDHEKSVVGQGNGELVSKIGKLEQELREVAALEVSLYSVVPEHGSSAHKLHTPARRLSRLYIHASKFWSEDKRASVAKSIASGLVLVAKSSSNDASRLTFWLSNTVVLREIIVQTFGISHQFTPSITTMNMNGATKKLDGKSMKMLWRNNSSHAKTGGMPDDWQETSTLLAALEKIESWIFSRIVETVWWQALTPHMQKRAEGSSTPKAGRVLGPALGDQQQGTFSVNLWKAAFNDAFNRMCPLRAGGHECGCLPVLAKLVMEQCVARLDVAMFNAILRESASEIPTDPISDPIVDPKVLPIPAGDLSFGSGAQLKNSIGNWSRWLTDKLGIDDDDSEDIGDVEDERRGAAETKSFQLLNELSDLLMLPKDMLLEKSIRKEVCPSIGLQLVTRILCNFTPDEFCPDAVPSTVLEELNSESLLERHTNKDMINVFPCIAAPTVYRAPSTLDAAEKVADIGGGAKLDRKASMVQRRGYTSDDDLDDLDSPLASLIDRSAPPSPSNGFAHFSAQRGVSMENTRYTLLREVWLEQR

SEQ ID NO: 4658 - protein, 695 aa, Zea mays
MGARDNGEGRDEKRGTGSDYVPARDSFSSQGESRVPKRLGKKESKDNSPRTTKSSASRQAQNKLQHKGLNNVQNKPQKQKKTVSAAKAVDVRKPDITRIPSRPPSELSEETDDIISDAGTVDDRGTEEAKEINVLDEAPRCDQSTGTDDEIPDIEDKVVDHGKSVVDQGNEELVLKIDKLEQELREVAALEVSLYSVVPEHGSSAHKLHTPARRLSRLYIHASKSWSEDKRASVAKSIASGLVLVAKSSSNDASRLTFWLSNTVVLREIIVQTFGISHQFTPSMTNMSMNGGAKKLGGKSMTMLWRNNYNGTQANFAARLMPDDWQETSTLLAALEKIESWIFSRIVETVWWQALTPHMQKRAEGSSTPKAGRVLGPALGDQQQGTFSVNLWKAAFQDAFSRMCPLSAGRHECGCLPVLAKLVMEQCVARLDVAMFNAILRESASEIPTDPISDPIVDPKVLPIPAGDLSFGSGAQLKNSIGNWSRWLTDKLGIDHDDSEDIGDVEDERRAAAETKSFQLLNELSDLLMLPKDMLLEKSIRKEVCPSIGLQLVTRILCNFTPDEFCPDPVPSTVLEELNSESLLERHANKDVTSVFPCTAAPIVYRTPSTLDAAERAADIGGGAKLDRKASMVQRRGYTSDDDLDDLDSPLASLIDRSAPPSPSNGLAHFSAGRGVSMENTRYTLLREVWGLEQR

SEQ ID NO: 4659 - protein, 695 aa, Panicum virgatum
MGARDNLEGREEKRGVGSDYVHARDSFSSQGESRVPRKLSKKETKENSPRTTKSSVSRLAQNKLQHKGLNNVQNKSQKQKKTVSAAKAVEVRKPDIARVPSRPPSELSEETDDIISDAGTIDDKGNEEAKEIDVLDEAPHCDQSTGTDDDIPDIEEKIVHHDKSVVGQGNEESASRIDKLEQELREVAALEVSLYSVVPEHGSSAHKLHTPARRLSRLYIHASKFWSADKRASVAKNIASGLVLVAKSSSNDASRLTFWLSNTVVVREIIAQTFGVSRVNPMMMTMTMNMNGGAKNLDGKPMTMLWRNSSNGKQAKLAAMQMPDDWQETSTFLASLEKIESWIFSRIVDTVWWQALTPHMQTPAEGSSTPKAGRVSGPALGDQQQGTFSVNLWKAAFHDAFSRMCPLRAGGHECGCLPVLAKLVMEQCVARLDVAMFNAILRESANEIPTDPISDPIVDPKVLPIPAGDLSFGSGAQLKNSIGNWSRWLTDKFGIDDDDSDIGNDDDDKRRGAAESKSFQLLNELSDLLMLPKDMLLEKSIRKEVCPSVGLQLVTRILCNFTPDEFCPDPVPSTVLEELNSESLLERCTNKDVLGAFPCIAAPVVYRAPSTSDAAEKVADIGGVPKLDRKASMVQRRGYTSDDDLDDLDSPLGSLIDRSAPPSPSNGIAHFSAQRGASMENVRYTLLREVWSERR

SEQ ID NO: 4660 - protein, 479 aa, Saccharum officinarum
MGARDNGEGRDEKKGTGSDYVPTRDPFSSQGESRVPKKLGKKETKDNSPRMTKSSAGRLAQNKLQHKGLNNVQNKSQKQKKTISAAKAVEVRKPDIARIPSRAPSELSEETDDIISDAGTVDDKGTEEAKEIDVLDEAPHCDQSTGTDDETPDIEDKVVDHEKSVVGQGNGELVSKIGKLEQELREVAALEVSLYSVVPEHGSSAHKLHTPARRLSRLYIHASKFWSEDKRASVAKSIASGLVLVAKSSSNDASRLTFWLSNTVVLREIIVQTFGISHQFTPSITTMNMNGATKKLDGKSMTMLWRNNSSHAKTGGMPDDWQETSTLLAALEKIESWIFSRIVETVWWQALTPHMQKRAEGSSTPKAGRVLGPALGDQQQGTFSVNLWKAAFNDAFNRMCPLRAGGHECGCLPVLAKLVMEQCVARLDVAMFNAILRESASEIPTDPISDPIVDPKVLPIPAGDLSFGSGAQLKNSVRA

SEQ ID NO: 4661 - protein, 692 aa, Pennisetum glaucum
MGARDNMEGREEKKGVGSDYVPARDSFPSQGESRVPRKLSKKEAKEYSPRATKSSASRQAQNKLQHKGINNVQNKSQKQKITVTTTKTVEVRKPDIARVPSRPPSELSEETDDIISDAGTVDDKGNEEAKEIDVLDEAPHCDQSTGTDDDIPDIEEKIVHHEKSVVGQGNEESESRIDKLEQELREVAALEVSLYSVVPEHGSSAHKLHTPARRLSRLYIHASKFWSADKRASVAKNIVSGLVLVAKSSSNDASRLTFWLSNTVVFREIIAQTFGISCVTPTTKAMNVNGAAKKLDGKPVTMLWRNSSSGKQAKFDAMQMPDDWQETSTLLASLEKIESWMFSRIVDTVWWQALTPHMQTRAEGSSTPRAGRVLGPALGDQRQGAFSVDLWKTAFHDAFSRMCPLRAGRHECGCLPVLAKLVMEQCVARLDVAMFNAILRESAFEIPTDPISDPIVDPKVLPIPAGDLSFGSGAQLKNSIGNWSRWLTDKFGIDDDDSNIGNNDDERRGADESKSFRLLNELSDLLMLPKDMLLEKSIRKEVCPSIGLQLVTRILCNFTPDEFCPDPVPSTVLEELNSESLMERCTGKDVISTFPCIAAPVVYHAPSTSDAAEKVADIGSGAKLDRKASLVQRRGYTSDDDLDDLDSPLASLIDRSAPPSPSNGIAHFSAQRGASMENTRYTLLREVWSERR

SEQ ID NO: 4662 - protein, 398 aa, Setaria italica
MSMDGGAKKLDGKPMTMLWRNSSNGKQAKLAAMQMPDDWQETSTLLASLEKIESWIFSRIVDTVWWQALTPHMQTPAEGSSTPRAGRVLGPALGDQRQGTFSVNLWKAAFHDAFSRMCPLRSGGHECGCLPVLAKLVMEQCVARLDVAMFNAILRESASEIPTDPISDPIVDPKVLPIPAGDLSFGSGAQLKNSIGNWSRWLTDKFGIDDDDSDIGNDDDERRGAAESKSFQLLNELSDLLMLPKDMLLEKSIRKEVCPSIGLQLVTSFTPDEFCPDPVPSTVLEELNSESLLERCTDKDVISAFPCIAAPVVYCAPSTLDAAEKVADIGGGAKLDRKASLVQRRGYTSDDDLDDLDSPLASLIDRSAPPSPSNGIAHFSAQRGASMENARYTLLREG

SEQ ID NO: 4663 - protein, 617 aa, Zea mays
MVAARGARSGGSVAAAALVSVLLVGCLVAGGQGAEIRRQKNVQAALRAKWAGTPLLLEASELLSTEWKDLFWDFIDLWKDLEKGSECLTAKCCAQKIVEDAHILLNEPLSSIFEFSLTLRSASPKLVLYRQLAKESLSSFPIDDSPENISGHGTGKTFDGAVDPGSSGGTCCWVDTGNVLLFNSADLHEWLGGLGKLAMDSTEQPELFEFDHIYRRTNITAPVAIFYGAVGTKCFKELHVQLVEASKQGKIRYALRPVLPSGCETTSTFCGSVGAVDAVTLSGYGVELALKNMEYKAMDDTAIKKGVPLEDPKTEDLSQEVRGFIFSKILERKPELNAEIMAFRDYLLSSAVSDTLEVWELKDLGHQTAQRIVQASDPLQSMQEINQNFPSIVSSLSRMKLDDSIKDEIIANQRMVPPGKSLMALNGALINIEDLDLYLLMDMVHGELSLADQFVRLKLPQSAVLKILSAPPPAESNSFRVDFRSSHVHYLNNLEEDAMYRRWRSNIQELLMPVFPGQMRYIRKKSVSTLFMCLILLQPVVQRLTIDMMVSLYQDSVPIRFGIIMYSSRFINVVEGSDGTLTNNDGEDTSILITRLFLVHQRNILNTVGIPISRQYT

SEQ ID NO: 4664 - DNA, 277 bp, Artificial Sequence
  NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 4665 - DNA, 2322 bp, Artificial Sequence
  AT 6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 4666 - DNA, 666 bp, Artificial Sequence
  35S pqfnc Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 4667 - DNA, 1127 bp, Artificial Sequence
  NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 4668 - DNA, 2318 bp, Artificial Sequence
  AT 6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 4669 - DNA, 1096 bp, Artificial Sequence
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 4670 - DNA, 31 bp, Artificial Sequence
  Single strand DNA oligonucleotide
aaaggatcccttgtcaatgtcgaactcaacg

SEQ ID NO: 4671 - DNA, 31 bp, Artificial Sequence
  Single strand DNA oligonucleotide
aaaggatccgagctttgatcttcaccgactg

SEQ ID NO: 4672 - DNA, 31 bp, Artificial Sequence
  Single strand DNA oligonucleotide
aaagtcgaccaataatccgtagttccgatcc

SEQ ID NO: 4673 - DNA, 30 bp, Artificial Sequence
  Single strand DNA oligonucleotide
aaaggatccaatccaatccaagcacatctc

SEQ ID NO: 4674 - DNA, 28 bp, Artificial Sequence
  Single strand DNA oligonucleotide
aaaggatccaggccagaccagaccagac

SEQ ID NO: 4675 - DNA, 28 bp, Artificial Sequence
  Single strand DNA oligonucleotide
aaactcgagaagaggaggacgagcatgg

SEQ ID NO: 4676 - DNA, 34 bp, Artificial Sequence
  Single strand DNA oligonucleotide
aaagtcgactgatgtagtagttccagacttccag

SEQ ID NO: 4677 - DNA, 31 bp, Artificial Sequence
  Single strand DNA oligonucleotide
aaactcgagcgatctggatccacaagaaatc

SEQ ID NO: 4678 - DNA, 28 bp, Artificial Sequence
  Single strand DNA oligonucleotide
aaaggatccccgttgcgtgttaggtttg

SEQ ID NO: 4679 - DNA, 30 bp, Artificial Sequence
  Single strand DNA oligonucleotide
aaaggatcctctggtatacaccaaccaccg

SEQ ID NO: 4680 - DNA, 31 bp, Artificial Sequence
  Single strand DNA oligonucleotide
aaaggatccatcacgcagtgacagtatttgc

SEQ ID NO: 4681 - DNA, 26 bp, Artificial Sequence
  Single strand DNA oligonucleotide
tttctcgagtcgccatggctcatggc

SEQ ID NO: 4682 - DNA, 27 bp, Artificial Sequence
  Single strand DNA oligonucleotide
aaaggatccaggcgcagtttctcatcg

SEQ ID NO: 4683 - DNA, 28 bp, Artificial Sequence
  Single strand DNA oligonucleotide
aaaggatccccaacgatactccgcactc

SEQ ID NO: 4684 - DNA, 29 bp, Artificial Sequence
  Single strand DNA oligonucleotide
aaaggatccgggaagtaaatcatggcgac

SEQ ID NO: 4685 - DNA, 29 bp, Artificial Sequence
  Single strand DNA oligonucleotide
aaaggatccaaaggagcaggcaaatctcc

SEQ ID NO: 4686 - DNA, 27 bp, Artificial Sequence
  Single strand DNA oligonucleotide
aaaggatcccatcgatccagctttgcg

SEQ ID NO: 4687 - DNA, 31 bp, Artificial Sequence
  Single strand DNA oligonucleotide
aaaggatccctgcgaattctagctctgaagc

SEQ ID NO: 4688 - DNA, 31 bp, Artificial Sequence
  Single strand DNA oligonucleotide
aaagtcgacctacggcactaccaccagtacc

SEQ ID NO: 4689 - DNA, 31 bp, Artificial Sequence
  Single strand DNA oligonucleotide
aaagtcgacgcggatagagttgttcttccag

SEQ ID NO: 4690 - DNA, 30 bp, Artificial Sequence
  Single strand DNA oligonucleotide
aaaggatccgggcgctagaacaagaagaag

SEQ ID NO: 4691 - DNA, 30 bp, Artificial Sequence
  Single strand DNA oligonucleotide
aaaggatccatgtccatgcacaggtaaagc

SEQ ID NO: 4692 - DNA, 29 bp, Artificial Sequence
  Single strand DNA oligonucleotide
aaaggatcccagtttgctgcagtctttgg

SEQ ID NO: 4693 - DNA, 28 bp, Artificial Sequence
  Single strand DNA oligonucleotide
aaaggatccagaggagagagcctgcctg

SEQ ID NO: 4694 - DNA, 26 bp, Artificial Sequence
  Single strand DNA oligonucleotide
ttaggatcctcgctcacccactctgc

SEQ ID NO: 4695 - DNA, 31 bp, Artificial Sequence
  Single strand DNA oligonucleotide
aaaggatccttgtagatcgagagcaaagcag

SEQ ID NO: 4696 - DNA, 29 bp, Artificial Sequence
  Single strand DNA oligonucleotide
aaagtcgacttatccctccgatcaccctc

SEQ ID NO: 4697 - DNA, 34 bp, Artificial Sequence
  Single strand DNA oligonucleotide
attggatcctgtaaatgggttccttagaaaatgg

SEQ ID NO: 4698 - DNA, 30 bp, Artificial Sequence
  Single strand DNA oligonucleotide
aaaggatcccaatagccatcgaggagaagg

SEQ ID NO: 4699 - DNA, 28 bp, Artificial Sequence
  Single strand DNA oligonucleotide
aaagtcgaccactcctcatcagccatcc

SEQ ID NO: 4700 - DNA, 31 bp, Artificial Sequence
  Single strand DNA oligonucleotide
aaagtcgacctcacccttcaatctttcgttc

SEQ ID NO: 4701 - DNA, 28 bp, Artificial Sequence
  Single strand DNA oligonucleotide
aaaggatccgatgtgaatccgtggaagg

SEQ ID NO: 4702 - DNA, 28 bp, Artificial Sequence
  Single strand DNA oligonucleotide
aaaggatcctccagtttccaccgtcaac

SEQ ID NO: 4703 - DNA, 29 bp, Artificial Sequence
  Single strand DNA oligonucleotide
aaaggatccgatcttgttgggcacactcc

SEQ ID NO: 4704 - DNA, 27 bp, Artificial Sequence
  Single strand DNA oligonucleotide
aaaggatccacctcgccacccaaattc

SEQ ID NO: 4705 - DNA, 29 bp, Artificial Sequence
  Single strand DNA oligonucleotide
aaaggatcccttctctcgttcaagcccac

SEQ ID NO: 4706 - DNA, 31 bp, Artificial Sequence
  Single strand DNA oligonucleotide
aaaggatcccaaagcatcttgagtgttcgac

SEQ ID NO: 4707 - DNA, 31 bp, Artificial Sequence
  Single strand DNA oligonucleotide
aaaggatccgtccctatacgtcgttgtccag

SEQ ID NO: 4708 - DNA, 31 bp, Artificial Sequence
  Single strand DNA oligonucleotide
ttaggatcctcgaatctctccaccgtgtaac

SEQ ID NO: 4709 - DNA, 31 bp, Artificial Sequence
  Single strand DNA oligonucleotide
aaaggatcccttgcctctgctgcgtataaag

SEQ ID NO: 4710 - DNA, 28 bp, Artificial Sequence
  Single strand DNA oligonucleotide
aaactcgagagaaccctaaacccgcatc

SEQ ID NO: 4711 - DNA, 28 bp, Artificial Sequence
  Single strand DNA oligonucleotide
aaaggatccacatcgaaatctccgcctc

SEQ ID NO: 4712 - DNA, 31 bp, Artificial Sequence
  Single strand DNA oligonucleotide
aaagtcgacccaagctaaggaggtgagaatc

SEQ ID NO: 4713 - DNA, 30 bp, Artificial Sequence
  Single strand DNA oligonucleotide
aaactcgagcgggtctatagccatgtcacc

SEQ ID NO: 4714 - DNA, 29 bp, Artificial Sequence
  Single strand DNA oligonucleotide
aaaggatccatcgccgcgtataaaggttc

SEQ ID NO: 4715 - DNA, 29 bp, Artificial Sequence
  Single strand DNA oligonucleotide
aaaggatccggcccatcgtcgatttatag

SEQ ID NO: 4716 - DNA, 30 bp, Artificial Sequence
  Single strand DNA oligonucleotide
aaaggatcccagctctagcagcaccatctc

SEQ ID NO: 4717 - DNA, 30 bp, Artificial Sequence
  Single strand DNA oligonucleotide
aaactcgagcaaacgaggcgtgataaagtg

SEQ ID NO: 4718 - DNA, 28 bp, Artificial Sequence
  Single strand DNA oligonucleotide
aaacccggggcgtttcctgaggaggttc

SEQ ID NO: 4719 - DNA, 31 bp, Artificial Sequence
  Single strand DNA oligonucleotide
aaaggatcctaccacgactaaaccacagctc

SEQ ID NO: 4720 - DNA, 30 bp, Artificial Sequence
  Single strand DNA oligonucleotide
aaagtcgacatcagcctttctcctcgtgtc

SEQ ID NO: 4721 - DNA, 31 bp, Artificial Sequence
  Single strand DNA oligonucleotide
aaaggatccagtgtaacctagccacacgacg

SEQ ID NO: 4722 - DNA, 31 bp, Artificial Sequence
  Single strand DNA oligonucleotide
aaagtcgacacatattcttgtgcttgcttgc

SEQ ID NO: 4723 - DNA, 27 bp, Artificial Sequence
  Single strand DNA oligonucleotide
aaaggatccgcgacgctgtcttcttcc

SEQ ID NO: 4724 - DNA, 30 bp, Artificial Sequence
  Single strand DNA oligonucleotide
aaaggatcctctcactgccatagtgccatc

SEQ ID NO: 4725 - DNA, 28 bp, Artificial Sequence
  Single strand DNA oligonucleotide
aaaggatcctctctatcgcgagcacgac

SEQ ID NO: 4726 - DNA, 31 bp, Artificial Sequence
  Single strand DNA oligonucleotide
aaaggatcctgaaagtcacaggacagcacac

SEQ ID NO: 4727 - DNA, 31 bp, Artificial Sequence
  Single strand DNA oligonucleotide
aaaggatccttcgcctcaagtttcatctagc

SEQ ID NO: 4728 - DNA, 27 bp, Artificial Sequence
  Single strand DNA oligonucleotide
aaactcgaggagtcagccaagccaagc

SEQ ID NO: 4729 - DNA, 31 bp, Artificial Sequence
  Single strand DNA oligonucleotide
aaaggatcccgtagccgtagcgataagagtg

SEQ ID NO: 4730 - DNA, 27 bp, Artificial Sequence
  Single strand DNA oligonucleotide
aaaggatccttcgcctccgatcttctg

SEQ ID NO: 4731 - DNA, 30 bp, Artificial Sequence
  Single strand DNA oligonucleotide
aaaggatccggtcaggacagaacagagcag

SEQ ID NO: 4732 - DNA, 33 bp, Artificial Sequence
  Single strand DNA oligonucleotide
aaaggatcccatcttccatagctgtacacatcc

SEQ ID NO: 4733 - DNA, 32 bp, Artificial Sequence
  Single strand DNA oligonucleotide
aaaggatccggccacactgacgagtagtagac

SEQ ID NO: 4734 - DNA, 26 bp, Artificial Sequence
  Single strand DNA oligonucleotide
tttggatcccctcgatggcgtcgcag

SEQ ID NO: 4735 - DNA, 31 bp, Artificial Sequence
  Single strand DNA oligonucleotide
aaaggatccccagtgaatcaagtcatcaacc

SEQ ID NO: 4736 - DNA, 31 bp, Artificial Sequence
  Single strand DNA oligonucleotide
aaaggatccagggagtgagcgagcactatac

SEQ ID NO: 4737 - DNA, 35 bp, Artificial Sequence
  Single strand DNA oligonucleotide
aaactcgaggttgacaagagttcacatttaattcg

SEQ ID NO: 4738 - DNA, 28 bp, Artificial Sequence
  Single strand DNA oligonucleotide
aaaggatcccatcacccgaaaccctagc

SEQ ID NO: 4739 - DNA, 26 bp, Artificial Sequence
  Single strand DNA oligonucleotide
aaaggatccccacgacggacatgcag

SEQ ID NO: 4740 - DNA, 29 bp, Artificial Sequence
  Single strand DNA oligonucleotide
aaaggatccgacggcaaaggtggtaactg

SEQ ID NO: 4741 - DNA, 26 bp, Artificial Sequence
  Single strand DNA oligonucleotide
aaaggatccgacgcttcgcctccctc

SEQ ID NO: 4742 - DNA, 29 bp, Artificial Sequence
  Single strand DNA oligonucleotide
aaaggatcccctggtccaaagtccaaacc

SEQ ID NO: 4743 - DNA, 29 bp, Artificial Sequence
  Single strand DNA oligonucleotide
aaaggatcccagtcctctgttccctccac

SEQ ID NO: 4744 - DNA, 31 bp, Artificial Sequence
  Single strand DNA oligonucleotide
aaaggatccgattcacaccagcttcaatacg

SEQ ID NO: 4745 - DNA, 27 bp, Artificial Sequence
  Single strand DNA oligonucleotide
aaaggatccgttgcccagcactcttgc

SEQ ID NO: 4746 - DNA, 28 bp, Artificial Sequence
  Single strand DNA oligonucleotide
aaaggatcccttatcctttcccggcctc

SEQ ID NO: 4747 - DNA, 27 bp, Artificial Sequence
  Single strand DNA oligonucleotide
tttctcgaggctccagtccagtccacg

SEQ ID NO: 4748 - DNA, 28 bp, Artificial Sequence
  Single strand DNA oligonucleotide
aaaggatccggtcttctgtcttcgcagc

SEQ ID NO: 4749 - DNA, 32 bp, Artificial Sequence
  Single strand DNA oligonucleotide
aaaggatccgtttcttggagaaggagagatgg

SEQ ID NO: 4750 - DNA, 31 bp, Artificial Sequence
  Single strand DNA oligonucleotide
aaactcgagaactgcttgcttctgtttggag

SEQ ID NO: 4751 - DNA, 31 bp, Artificial Sequence
  Single strand DNA oligonucleotide
aaaggatccctgcacaaacttgagcacctac

SEQ ID NO: 4752 - DNA, 28 bp, Artificial Sequence
  Single strand DNA oligonucleotide
aaaggatccatcggatcggagagcctac

SEQ ID NO: 4753 - DNA, 30 bp, Artificial Sequence
  Single strand DNA oligonucleotide
aaagtcgaccctaggaggaaagaaacgcac

SEQ ID NO: 4754 - DNA, 30 bp, Artificial Sequence
  Single strand DNA oligonucleotide
aaaggatccacaagccaaggcaaagagaag

SEQ ID NO: 4755 - DNA, 31 bp, Artificial Sequence
  Single strand DNA oligonucleotide
aaaggatcccatctacgattacaggacgtgg

SEQ ID NO: 4756 - DNA, 31 bp, Artificial Sequence
  Single strand DNA oligonucleotide
aaagtcgaccgatctttgcagacactgaaac

SEQ ID NO: 4757 - DNA, 32 bp, Artificial Sequence
  Single strand DNA oligonucleotide
aaaggatcctctccagtaggtagagtggcaag

SEQ ID NO: 4758 - DNA, 31 bp, Artificial Sequence
  Single strand DNA oligonucleotide
aaaggatccaatctagagggctgtttcgagg

SEQ ID NO: 4759 - DNA, 32 bp, Artificial Sequence
  Single strand DNA oligonucleotide
aaaggatccgagccagcagtaacagtaagcag

SEQ ID NO: 4760 - DNA, 27 bp, Artificial Sequence
  Single strand DNA oligonucleotide
aaagtcgaccgcttcgttgccaacttc

SEQ ID NO: 4761 - DNA, 31 bp, Artificial Sequence
  Single strand DNA oligonucleotide
aaaggatcccatcagtcatcacacagagtgc

SEQ ID NO: 4762 - DNA, 30 bp, Artificial Sequence
  Single strand DNA oligonucleotide
aaagtcgacctcttccagttccagcaacac

SEQ ID NO: 4763 - DNA, 31 bp, Artificial Sequence
  Single strand DNA oligonucleotide
aaaggatccgctcgactgaatcaactgtttg

SEQ ID NO: 4764 - DNA, 29 bp, Artificial Sequence
  Single strand DNA oligonucleotide
aaagtcgaccgatcctctcttggatctcg

SEQ ID NO: 4765 - DNA, 28 bp, Artificial Sequence
  Single strand DNA oligonucleotide
aaaggatccacggttgagagccacacac

SEQ ID NO: 4766 - DNA, 31 bp, Artificial Sequence
  Single strand DNA oligonucleotide
aaagaattcgttaatttctcgcttggattgg

SEQ ID NO: 4767 - DNA, 31 bp, Artificial Sequence
  Single strand DNA oligonucleotide
aaaggatcccgcttctacaactccaccactc

SEQ ID NO: 4768 - DNA, 33 bp, Artificial Sequence
  Single strand DNA oligonucleotide
aaagtcgacagaagaaccatcatcatcatcagc

SEQ ID NO: 4769 - DNA, 32 bp, Artificial Sequence
  Single strand DNA oligonucleotide
aaagtcgacttcacaggtctaggcatttatcc

SEQ ID NO: 4770 - DNA, 28 bp, Artificial Sequence
  Single strand DNA oligonucleotide
aaagtcgaccggaccatgaaaatgagcc

SEQ ID NO: 4771 - DNA, 27 bp, Artificial Sequence
  Single strand DNA oligonucleotide
aaagtcgaccaccagctacctccctgc

SEQ ID NO: 4772 - DNA, 31 bp, Artificial Sequence
  Single strand DNA oligonucleotide
aaagtcgactcgcctactccctagtccctac

SEQ ID NO: 4773 - DNA, 28 bp, Artificial Sequence
  Single strand DNA oligonucleotide
aaactcgaggaggagaagcagagcagcg

SEQ ID NO: 4774 - DNA, 27 bp, Artificial Sequence
  Single strand DNA oligonucleotide
aaaggatccaaacgaagcagaggccag

SEQ ID NO: 4775 - DNA, 29 bp, Artificial Sequence
  Single strand DNA oligonucleotide
aaagatatcgtcctctgttccagcgtttc

SEQ ID NO: 4776 - DNA, 31 bp, Artificial Sequence
  Single strand DNA oligonucleotide
aaagaattcctacacgagagtgaagtgggag

SEQ ID NO: 4777 - DNA, 30 bp, Artificial Sequence
  Single strand DNA oligonucleotide
aaaggatccatcagctgagctctcctcgtc

SEQ ID NO: 4778 - DNA, 30 bp, Artificial Sequence
  Single strand DNA oligonucleotide
aaagtcgacagtccagtggagtggaggaag

SEQ ID NO: 4779 - DNA, 29 bp, Artificial Sequence
  Single strand DNA oligonucleotide
aaaggatccgtggttgcgcacttgttatg

SEQ ID NO: 4780 - DNA, 29 bp, Artificial Sequence
  Single strand DNA oligonucleotide
aaaggatccgacgtgcttgccattctctc

SEQ ID NO: 4781 - DNA, 28 bp, Artificial Sequence
  Single strand DNA oligonucleotide
taagtcgacaacggcatgggtggtattg

SEQ ID NO: 4782 - DNA, 28 bp, Artificial Sequence
  Single strand DNA oligonucleotide
ttaggatccgccaccatgctgtcactct

SEQ ID NO: 4783 - DNA, 35 bp, Artificial Sequence
  Single strand DNA oligonucleotide
aaaggatccaatttaggaagatctccaactccttc

SEQ ID NO: 4784 - DNA, 30 bp, Artificial Sequence
  Single strand DNA oligonucleotide
aaagtcgacaagctagctgctccttcctcc

SEQ ID NO: 4785 - DNA, 30 bp, Artificial Sequence
  Single strand DNA oligonucleotide
aaagatatctggtgcaagaccaagatcaag

SEQ ID NO: 4786 - DNA, 32 bp, Artificial Sequence
  Single strand DNA oligonucleotide
aaaggatccggagacggcatcaagtttctaac

SEQ ID NO: 4787 - DNA, 31 bp, Artificial Sequence
  Single strand DNA oligonucleotide
aaacccgggcggttctatatgccatagccag

SEQ ID NO: 4788 - DNA, 32 bp, Artificial Sequence
  Single strand DNA oligonucleotide
aaaggatcccccataatcccttgtaagagagg

SEQ ID NO: 4789 - DNA, 35 bp, Artificial Sequence
  Single strand DNA oligonucleotide
aaaggatccgcaatagttactcacctttgatcctc

SEQ ID NO: 4790 - DNA, 28 bp, Artificial Sequence
  Single strand DNA oligonucleotide
aaagatatccgtctcgctcaacatgagg

SEQ ID NO: 4791 - DNA, 30 bp, Artificial Sequence
  Single strand DNA oligonucleotide
aaagtcgacagcctttccattccatctcac

SEQ ID NO: 4792 - DNA, 28 bp, Artificial Sequence
  Single strand DNA oligonucleotide
aaaggatcctactcccagcctcccactc

SEQ ID NO: 4793 - DNA, 31 bp, Artificial Sequence
  Single strand DNA oligonucleotide
aaaggatcccattactgctccacccatatcc

SEQ ID NO: 4794 - DNA, 29 bp, Artificial Sequence
  Single strand DNA oligonucleotide
aaaggatccaaatactccgctcgctctcc

SEQ ID NO: 4795 - DNA, 31 bp, Artificial Sequence
  Single strand DNA oligonucleotide
aaagaattccgatatcttcctctcccgtagg

SEQ ID NO: 4796 - DNA, 27 bp, Artificial Sequence
  Single strand DNA oligonucleotide
aaaggatcccggcaaccacttgctatg

SEQ ID NO: 4797 - DNA, 25 bp, Artificial Sequence
  Single strand DNA oligonucleotide
tttgtcgactggcgccgtcaggagg

SEQ ID NO: 4798 - DNA, 27 bp, Artificial Sequence
  Single strand DNA oligonucleotide
aaagtcgaccgcgctctggttttcttc

SEQ ID NO: 4799 - DNA, 29 bp, Artificial Sequence
  Single strand DNA oligonucleotide
ttcggatccagcttctctcctctcggcct

SEQ ID NO: 4800 - DNA, 31 bp, Artificial Sequence
  Single strand DNA oligonucleotide
aaactcgagaaccttatcggccttcttgttg

SEQ ID NO: 4801 - DNA, 26 bp, Artificial Sequence
  Single strand DNA oligonucleotide
ttaggatccagctcatttccaccccg

SEQ ID NO: 4802 - DNA, 29 bp, Artificial Sequence
  Single strand DNA oligonucleotide
aaaggatccaaccttaaaccctgcgaacc

SEQ ID NO: 4803 - DNA, 29 bp, Artificial Sequence
  Single strand DNA oligonucleotide
tttctcgagcaggatcctaggccaaatgc

SEQ ID NO: 4804 - DNA, 29 bp, Artificial Sequence
  Single strand DNA oligonucleotide
aaagtcgaccggatcgaagaggtacaagc

SEQ ID NO: 4805 - DNA, 32 bp, Artificial Sequence
  Single strand DNA oligonucleotide
tttggatccagagcatcatttccttgtcaatg

SEQ ID NO: 4806 - DNA, 31 bp, Artificial Sequence
  Single strand DNA oligonucleotide
aaaggatcccacactctgcaacacctctcac

SEQ ID NO: 4807 - DNA, 32 bp, Artificial Sequence
  Single strand DNA oligonucleotide
aaaggatcctcgagtcttgtctctctccaatc

SEQ ID NO: 4808 - DNA, 27 bp, Artificial Sequence
  Single strand DNA oligonucleotide
aaaggatccaacacctgccagccactg

SEQ ID NO: 4809 - DNA, 31 bp, Artificial Sequence
  Single strand DNA oligonucleotide
aaagtcgacccaactagcgaggaaccctaac

SEQ ID NO: 4810 - DNA, 31 bp, Artificial Sequence
  Single strand DNA oligonucleotide
aaaggatcctccatttcttgtctgttccagg

SEQ ID NO: 4811 - DNA, 29 bp, Artificial Sequence
  Single strand DNA oligonucleotide
aaaggatccctccaatccaatccaagcac

SEQ ID NO: 4812 - DNA, 27 bp, Artificial Sequence
  Single strand DNA oligonucleotide
aaaggatcccccaacaacagaggccag

SEQ ID NO: 4813 - DNA, 28 bp, Artificial Sequence
  Single strand DNA oligonucleotide
aaactcgagacttgacattcccggcttc

SEQ ID NO: 4814 - DNA, 30 bp, Artificial Sequence
  Single strand DNA oligonucleotide
aaaggatccgagccggaggttctttctagg

SEQ ID NO: 4815 - DNA, 26 bp, Artificial Sequence
  Single strand DNA oligonucleotide
aaaggatcctgacgcagcggagtcac

SEQ ID NO: 4816 - DNA, 31 bp, Artificial Sequence
  Single strand DNA oligonucleotide
aaaggatccagtgtaacatcacatcacgcag

SEQ ID NO: 4817 - DNA, 33 bp, Artificial Sequence
  Single strand DNA oligonucleotide
aaaggatccaaacttaggcaccaacgatactcc

SEQ ID NO: 4818 - DNA, 31 bp, Artificial Sequence
  Single strand DNA oligonucleotide
aaaggatcctagatctaccaccaacgccatc

SEQ ID NO: 4819 - DNA, 30 bp, Artificial Sequence
  Single strand DNA oligonucleotide
aaaggatccgcttaagcttctgagccttcc

SEQ ID NO: 4820 - DNA, 35 bp, Artificial Sequence
  Single strand DNA oligonucleotide
aaaggatccggcatcctcctctctacagttaatac

SEQ ID NO: 4821 - DNA, 30 bp, Artificial Sequence
  Single strand DNA oligonucleotide
aaaggatcccgccagtacaccaacaatagg

SEQ ID NO: 4822 - DNA, 31 bp, Artificial Sequence
  Single strand DNA oligonucleotide
aaagtcgacagtcaagagagctaccgaggag

SEQ ID NO: 4823 - DNA, 27 bp, Artificial Sequence
  Single strand DNA oligonucleotide
aaagtcgacctcaaactctgcccccgt

SEQ ID NO: 4824 - DNA, 32 bp, Artificial Sequence
  Single strand DNA oligonucleotide
aaaggatcccactgtgctactcccaccttatc

SEQ ID NO: 4825 - DNA, 29 bp, Artificial Sequence
  Single strand DNA oligonucleotide
aaaggatccaggctctcacctgctactgc

SEQ ID NO: 4826 - DNA, 31 bp, Artificial Sequence
  Single strand DNA oligonucleotide
aaaggatccctctctgtcactccatgagtcc

SEQ ID NO: 4827 - DNA, 35 bp, Artificial Sequence
  Single strand DNA oligonucleotide
tttgtcgacgtaccttcatttgttaactcgcacag

SEQ ID NO: 4828 - DNA, 27 bp, Artificial Sequence
  Single strand DNA oligonucleotide
aaaggatcctcccgagtctcgatttgc

SEQ ID NO: 4829 - DNA, 30 bp, Artificial Sequence
  Single strand DNA oligonucleotide
aaaggatcctgagcttgaggaagcagtttg

SEQ ID NO: 4830 - DNA, 28 bp, Artificial Sequence
  Single strand DNA oligonucleotide
aaaggatccgctgaagcaagcaaagcag

SEQ ID NO: 4831 - DNA, 29 bp, Artificial Sequence
  Single strand DNA oligonucleotide
aaagtcgaccgaattatccctccgatcac

SEQ ID NO: 4832 - DNA, 31 bp, Artificial Sequence
  Single strand DNA oligonucleotide
aaaggatccctgaaactcaactagccgttgg

SEQ ID NO: 4833 - DNA, 27 bp, Artificial Sequence
  Single strand DNA oligonucleotide
aaagtcgacactcggccactcctcatc

SEQ ID NO: 4834 - DNA, 28 bp, Artificial Sequence
  Single strand DNA oligonucleotide
aaaggatccctgccgcattgcataattc

SEQ ID NO: 4835 - DNA, 31 bp, Artificial Sequence
  Single strand DNA oligonucleotide
aaaggatcctggacctgcttagtaccacatc

SEQ ID NO: 4836 - DNA, 30 bp, Artificial Sequence
  Single strand DNA oligonucleotide
aaaggatcccatctctttcgtgctcctacc

SEQ ID NO: 4837 - DNA, 31 bp, Artificial Sequence
  Single strand DNA oligonucleotide
aaaggatccagtccctgaaacgaaagagttg

SEQ ID NO: 4838 - DNA, 32 bp, Artificial Sequence
  Single strand DNA oligonucleotide
aaaggatccgcaacaaagcatcttgagtgttc

SEQ ID NO: 4839 - DNA, 29 bp, Artificial Sequence
  Single strand DNA oligonucleotide
aaaggatcccgagctcgaaggactttgtc

SEQ ID NO: 4840 - DNA, 30 bp, Artificial Sequence
  Single strand DNA oligonucleotide
ttaggatccagcgtgtcgagattcgtgtcc

SEQ ID NO: 4841 - DNA, 31 bp, Artificial Sequence
  Single strand DNA oligonucleotide
aaaggatccctacagaaacctccattgccag

SEQ ID NO: 4842 - DNA, 35 bp, Artificial Sequence
  Single strand DNA oligonucleotide
aaactcgagctctcactagaacagaaccctaaacc

SEQ ID NO: 4843 - DNA, 31 bp, Artificial Sequence
  Single strand DNA oligonucleotide
aaagtcgacagctctgtgctctccaaatcag

SEQ ID NO: 4844 - DNA, 31 bp, Artificial Sequence
  Single strand DNA oligonucleotide
aaaggatcccatactgcattcactcacctcc

SEQ ID NO: 4845 - DNA, 30 bp, Artificial Sequence
  Single strand DNA oligonucleotide
aaaggatcctgggtagctcctgctcctatc

SEQ ID NO: 4846 - DNA, 28 bp, Artificial Sequence
  Single strand DNA oligonucleotide
aaaggatcctattcgctcccacatccac

SEQ ID NO: 4847 - DNA, 31 bp, Artificial Sequence
  Single strand DNA oligonucleotide
aaactcgagccttatccacaccagcagattc

SEQ ID NO: 4848 - DNA, 30 bp, Artificial Sequence
  Single strand DNA oligonucleotide
aaacccggggctttgggattgattccactc

SEQ ID NO: 4849 - DNA, 33 bp, Artificial Sequence
  Single strand DNA oligonucleotide
aaaggatccccatctgttgtaccacgactaaac

SEQ ID NO: 4850 - DNA, 29 bp, Artificial Sequence
  Single strand DNA oligonucleotide
aaagtcgacgaatcgcatcagcctttctc

SEQ ID NO: 4851 - DNA, 32 bp, Artificial Sequence
  Single strand DNA oligonucleotide
aaaggatccaaatatctgcctgcctacctacc

SEQ ID NO: 4852 - DNA, 30 bp, Artificial Sequence
  Single strand DNA oligonucleotide
aaagtcgacgatggaaacccagtgagacac

SEQ ID NO: 4853 - DNA, 32 bp, Artificial Sequence
  Single strand DNA oligonucleotide
aaaggatcctggtggtggtcgtatcttatctc

SEQ ID NO: 4854 - DNA, 32 bp, Artificial Sequence
  Single strand DNA oligonucleotide
aaaggatccaacgctcaacttgaaagtcacag

SEQ ID NO: 4855 - DNA, 32 bp, Artificial Sequence
  Single strand DNA oligonucleotide
aaaggatccaagcagctcagtttcatcacaag

SEQ ID NO: 4856 - DNA, 27 bp, Artificial Sequence
  Single strand DNA oligonucleotide
aaactcgaggcaagcgagtcagccaag

SEQ ID NO: 4857 - DNA, 31 bp, Artificial Sequence
  Single strand DNA oligonucleotide
aaaggatccaataaccgttccactttggtcc

SEQ ID NO: 4858 - DNA, 28 bp, Artificial Sequence
  Single strand DNA oligonucleotide
aaaggatccgccctaccattgagggttc

SEQ ID NO: 4859 - DNA, 31 bp, Artificial Sequence
  Single strand DNA oligonucleotide
aaaggatccgagcttctgagccttatcccag

SEQ ID NO: 4860 - DNA, 31 bp, Artificial Sequence
  Single strand DNA oligonucleotide
aaaggatccttatcctcgctcactttccatc

SEQ ID NO: 4861 - DNA, 31 bp, Artificial Sequence
  Single strand DNA oligonucleotide
aaaggatccacacagcatcaacccactacag

SEQ ID NO: 4862 - DNA, 33 bp, Artificial Sequence
  Single strand DNA oligonucleotide
aaaggatcccgctaatagcctctctcatctcag

SEQ ID NO: 4863 - DNA, 32 bp, Artificial Sequence
  Single strand DNA oligonucleotide
aaaggatcctcaactgcaagcttacatcacac

SEQ ID NO: 4864 - DNA, 28 bp, Artificial Sequence
  Single strand DNA oligonucleotide
aaactcgagggtttgcatggtctcatcg

SEQ ID NO: 4865 - DNA, 33 bp, Artificial Sequence
  Single strand DNA oligonucleotide
aaaggatccttcactcactcactcacactgaac

SEQ ID NO: 4866 - DNA, 28 bp, Artificial Sequence
  Single strand DNA oligonucleotide
aaaggatccacctgtccctggtccaaag

SEQ ID NO: 4867 - DNA, 31 bp, Artificial Sequence
  Single strand DNA oligonucleotide
aaaggatcccgaccatctcctcaacctaaac

SEQ ID NO: 4868 - DNA, 28 bp, Artificial Sequence
  Single strand DNA oligonucleotide
tttggatccgattcgtacgttgcccagc

SEQ ID NO: 4869 - DNA, 30 bp, Artificial Sequence
  Single strand DNA oligonucleotide
aaaggatccaaccctggtcttctgtcttcg

SEQ ID NO: 4870 - DNA, 29 bp, Artificial Sequence
  Single strand DNA oligonucleotide
aaactcgagcaattgcaaacgaaagggac

SEQ ID NO: 4871 - DNA, 31 bp, Artificial Sequence
  Single strand DNA oligonucleotide
aaactcgagacctctcgctaaatcctcttcc

SEQ ID NO: 4872 - DNA, 31 bp, Artificial Sequence
  Single strand DNA oligonucleotide
aaaggatccgagtactccaccatctccatcc

SEQ ID NO: 4873 - DNA, 31 bp, Artificial Sequence
  Single strand DNA oligonucleotide
aaaggatccctcgacagtttctctcagcctc

SEQ ID NO: 4874 - DNA, 29 bp, Artificial Sequence
  Single strand DNA oligonucleotide
aaagtcgacgggaggaacaactcatcagg

SEQ ID NO: 4875 - DNA, 29 bp, Artificial Sequence
  Single strand DNA oligonucleotide
aaaggatccagccatcacagaaagcaagc

SEQ ID NO: 4876 - DNA, 30 bp, Artificial Sequence
  Single strand DNA oligonucleotide
aaaggatccaatgccaaatctagagggctg

SEQ ID NO: 4877 - DNA, 31 bp, Artificial Sequence
  Single strand DNA oligonucleotide
aaaggatccacaaatactaatcggagccacc

SEQ ID NO: 4878 - DNA, 27 bp, Artificial Sequence
  Single strand DNA oligonucleotide
aaagtcgacgcaggcccagtttctttg

SEQ ID NO: 4879 - DNA, 30 bp, Artificial Sequence
  Single strand DNA oligonucleotide
aaaggatccgagcacgtacgggttccatag

SEQ ID NO: 4880 - DNA, 34 bp, Artificial Sequence
  Single strand DNA oligonucleotide
aaagtcgacgctcctatagtcctaggctagctcc

SEQ ID NO: 4881 - DNA, 31 bp, Artificial Sequence
  Single strand DNA oligonucleotide
aaaggatccccgtcccgtgctgataatatac

SEQ ID NO: 4882 - DNA, 31 bp, Artificial Sequence
  Single strand DNA oligonucleotide
aaagaattccgatccctttcttcatcagttc

SEQ ID NO: 4883 - DNA, 31 bp, Artificial Sequence
  Single strand DNA oligonucleotide
aaaggatccacacttccgaattcaccaactc

SEQ ID NO: 4884 - DNA, 32 bp, Artificial Sequence
  Single strand DNA oligonucleotide
aaagtcgactcacagccataatacctgttcac

SEQ ID NO: 4885 - DNA, 27 bp, Artificial Sequence
  Single strand DNA oligonucleotide
aaagtcgacatcgcaccagctacctcc

SEQ ID NO: 4886 - DNA, 31 bp, Artificial Sequence
  Single strand DNA oligonucleotide
aaagtcgacccgttcgatccctcattcttac

SEQ ID NO: 4887 - DNA, 31 bp, Artificial Sequence
  Single strand DNA oligonucleotide
aaagatatcaaagacactagcgagccttcac

SEQ ID NO: 4888 - DNA, 30 bp, Artificial Sequence
  Single strand DNA oligonucleotide
aaagaattcggtcgagttcagagctagtcg

SEQ ID NO: 4889 - DNA, 30 bp, Artificial Sequence
  Single strand DNA oligonucleotide
aaaggatccacaggcggttggagataattg

SEQ ID NO: 4890 - DNA, 28 bp, Artificial Sequence
  Single strand DNA oligonucleotide
aaaggatccagcgttccctcaccaagag

SEQ ID NO: 4891 - DNA, 30 bp, Artificial Sequence
  Single strand DNA oligonucleotide
tttgtcgacgtacgcttgagctcaaacctc

SEQ ID NO: 4892 - DNA, 29 bp, Artificial Sequence
  Single strand DNA oligonucleotide
aaaggatccgattcgaattcgacctcgac

SEQ ID NO: 4893 - DNA, 27 bp, Artificial Sequence
  Single strand DNA oligonucleotide
ttcggatccccttatcgccaccatgct

SEQ ID NO: 4894 - DNA, 31 bp, Artificial Sequence
  Single strand DNA oligonucleotide
aaagtcgacgagcagtcgttcgttgaagaag

SEQ ID NO: 4895 - DNA, 32 bp, Artificial Sequence
  Single strand DNA oligonucleotide
aaactcgagacgtacgtagtccagctgatttg

SEQ ID NO: 4896 - DNA, 31 bp, Artificial Sequence
  Single strand DNA oligonucleotide
aaaggatccgctggatttaagcagagcagag

SEQ ID NO: 4897 - DNA, 31 bp, Artificial Sequence
  Single strand DNA oligonucleotide
aaacccgggcatgacttgctctgctcttcag

SEQ ID NO: 4898 - DNA, 32 bp, Artificial Sequence
  Single strand DNA oligonucleotide
aaaggatcctcatccagctgatgtagcaatag

SEQ ID NO: 4899 - DNA, 32 bp, Artificial Sequence
  Single strand DNA oligonucleotide
aaaggatcctagaaggaagcaagtgtgtgtcc

SEQ ID NO: 4900 - DNA, 31 bp, Artificial Sequence
  Single strand DNA oligonucleotide
aaagtcgacaacagctcatccacatccaaag

SEQ ID NO: 4901 - DNA, 30 bp, Artificial Sequence
  Single strand DNA oligonucleotide
aaaggatcctcctctcctttcacgaactcc

SEQ ID NO: 4902 - DNA, 29 bp, Artificial Sequence
  Single strand DNA oligonucleotide
aaaggatccaggctctggtagcacgacac

SEQ ID NO: 4903 - DNA, 27 bp, Artificial Sequence
  Single strand DNA oligonucleotide
aaaggatccagaggagggagtggcgtc

SEQ ID NO: 4904 - DNA, 28 bp, Artificial Sequence
  Single strand DNA oligonucleotide
aaagaattcacgcgtcttctcctccaac

SEQ ID NO: 4905 - DNA, 32 bp, Artificial Sequence
  Single strand DNA oligonucleotide
ttcggatccactcactgagcttccttcctctc

SEQ ID NO: 4906 - DNA, 34 bp, Artificial Sequence
  Single strand DNA oligonucleotide
aaaggatccaaaagagagagcttctctcctctcg

SEQ ID NO: 4907 - DNA, 33 bp, Artificial Sequence
  Single strand DNA oligonucleotide
tatctcgagctaaaaccttatcggccttcttgt

SEQ ID NO: 4908 - DNA, 28 bp, Artificial Sequence
  Single strand DNA oligonucleotide
tttctcgagttgtcggcaggatcctagg

SEQ ID NO: 4909 - DNA, 35 bp, Artificial Sequence
  Single strand DNA oligonucleotide
tttggtaccttattacttgtcttgctccggtgtag

SEQ ID NO: 4910 - DNA, 30 bp, Artificial Sequence
  Single strand DNA oligonucleotide
aaactcgagacagaacccaggcagaatcag

SEQ ID NO: 4911 - DNA, 31 bp, Artificial Sequence
  Single strand DNA oligonucleotide
aaagaattccataccatgtcagcaacatcac

SEQ ID NO: 4912 - DNA, 31 bp, Artificial Sequence
  Single strand DNA oligonucleotide
aaaggtaccttgacaactcaaacgcctaaag

SEQ ID NO: 4913 - DNA, 31 bp, Artificial Sequence
  Single strand DNA oligonucleotide
aaaggtaccaacgaacaaacacacattcagg

SEQ ID NO: 4914 - DNA, 31 bp, Artificial Sequence
  Single strand DNA oligonucleotide
aaagagctcacaacatatcagctccctcgac

SEQ ID NO: 4915 - DNA, 31 bp, Artificial Sequence
  Single strand DNA oligonucleotide
aaagaattcctagaccaaatgccacaatacc

SEQ ID NO: 4916 - DNA, 34 bp, Artificial Sequence
  Single strand DNA oligonucleotide
aaagaattcctaacatgctacatgggaactgaag

SEQ ID NO: 4917 - DNA, 33 bp, Artificial Sequence
  Single strand DNA oligonucleotide
tttgaattctcaagtccaacttcatctgccacc

SEQ ID NO: 4918 - DNA, 29 bp, Artificial Sequence
  Single strand DNA oligonucleotide
aaactcgagcatggatctaccacgacacg

SEQ ID NO: 4919 - DNA, 32 bp, Artificial Sequence
  Single strand DNA oligonucleotide
tttaggcctctaagatcatgcatcgttgagcc

SEQ ID NO: 4920 - DNA, 31 bp, Artificial Sequence
  Single strand DNA oligonucleotide
aaactcgagtacactcgcattagcaggacac

SEQ ID NO: 4921 - DNA, 31 bp, Artificial Sequence
  Single strand DNA oligonucleotide
aaactcgaggggacaattcagtgatttcagg

SEQ ID NO: 4922 - DNA, 31 bp, Artificial Sequence
  Single strand DNA oligonucleotide
aaactcgagatggttctctatccctccttgc

SEQ ID NO: 4923 - DNA, 31 bp, Artificial Sequence
  Single strand DNA oligonucleotide
aaaggtaccttccaaggtgagacaccaatag

SEQ ID NO: 4924 - DNA, 34 bp, Artificial Sequence
  Single strand DNA oligonucleotide
tttctcgagtcaacggctctgtttggttcttcag

SEQ ID NO: 4925 - DNA, 31 bp, Artificial Sequence
  Single strand DNA oligonucleotide
aaactcgagataacctttcttcgtcaggcac

SEQ ID NO: 4926 - DNA, 29 bp, Artificial Sequence
  Single strand DNA oligonucleotide
aaaggatccttgcaaggttgtctggtctc

SEQ ID NO: 4927 - DNA, 34 bp, Artificial Sequence
  Single strand DNA oligonucleotide
aaaggatccctaggagttggtaaagcttctgtgg

SEQ ID NO: 4928 - DNA, 32 bp, Artificial Sequence
  Single strand DNA oligonucleotide
aaactcgagctacagtagtgccagagccttcc

SEQ ID NO: 4929 - DNA, 31 bp, Artificial Sequence
  Single strand DNA oligonucleotide
aaactcgagacgctgcgtgtatgtatgattg

SEQ ID NO: 4930 - DNA, 31 bp, Artificial Sequence
  Single strand DNA oligonucleotide
aaaggtaccgtgggaaatggctatctttgag

SEQ ID NO: 4931 - DNA, 31 bp, Artificial Sequence
  Single strand DNA oligonucleotide
aaaggtacctattaattggccgtgtccactc

SEQ ID NO: 4932 - DNA, 31 bp, Artificial Sequence
  Single strand DNA oligonucleotide
aatggtacctaaccgcctatctcaacaaatg

SEQ ID NO: 4933 - DNA, 34 bp, Artificial Sequence
  Single strand DNA oligonucleotide
aaactcgagtgaatccaaccaatttaagaatcac

SEQ ID NO: 4934 - DNA, 31 bp, Artificial Sequence
  Single strand DNA oligonucleotide
aaagaattctgtgcacaataaacgaacaagc

SEQ ID NO: 4935 - DNA, 36 bp, Artificial Sequence
  Single strand DNA oligonucleotide
aaagaattcgaattatcaaactaggttctattgcca

SEQ ID NO: 4936 - DNA, 34 bp, Artificial Sequence
  Single strand DNA oligonucleotide
aaactcgagctactctaggcgacccaaatattcc

SEQ ID NO: 4937 - DNA, 31 bp, Artificial Sequence
  Single strand DNA oligonucleotide
aaaaggcctggtggtggaatactcacctctg

SEQ ID NO: 4938 - DNA, 31 bp, Artificial Sequence
  Single strand DNA oligonucleotide
aaaggatcctccagcaacataatagcccttg

SEQ ID NO: 4939 - DNA, 31 bp, Artificial Sequence
  Single strand DNA oligonucleotide
aaaggtaccaaataatgcatctgttcgcttg

SEQ ID NO: 4940 - DNA, 31 bp, Artificial Sequence
  Single strand DNA oligonucleotide
aaaggtacccaagcatgtgagaaccagctac

SEQ ID NO: 4941 - DNA, 31 bp, Artificial Sequence
  Single strand DNA oligonucleotide
aaactcgaggggtacatcatccacctacacc

SEQ ID NO: 4942 - DNA, 32 bp, Artificial Sequence
  Single strand DNA oligonucleotide
aaactcgagttgtatgcggatcagtacatcag

SEQ ID NO: 4943 - DNA, 31 bp, Artificial Sequence
  Single strand DNA oligonucleotide
aaactcgagtgcctctttcattcaacaacag

SEQ ID NO: 4944 - DNA, 33 bp, Artificial Sequence
  Single strand DNA oligonucleotide
aaaggtaccaaactcgacagctagacaaactgg

SEQ ID NO: 4945 - DNA, 32 bp, Artificial Sequence
  Single strand DNA oligonucleotide
aaactcgagctaccgaacgacatgatgacaag

SEQ ID NO: 4946 - DNA, 32 bp, Artificial Sequence
  Single strand DNA oligonucleotide
aaggaattcgttcaatcgcatctttaatacgc

SEQ ID NO: 4947 - DNA, 31 bp, Artificial Sequence
  Single strand DNA oligonucleotide
aaaggtacctgaggtcctcgcactatcaatc

SEQ ID NO: 4948 - DNA, 29 bp, Artificial Sequence
  Single strand DNA oligonucleotide
aaagaattcaaacagctcaacgaatcacg

SEQ ID NO: 4949 - DNA, 31 bp, Artificial Sequence
  Single strand DNA oligonucleotide
aaaggtaccatctcaaacccaaagcaagaag

SEQ ID NO: 4950 - DNA, 34 bp, Artificial Sequence
  Single strand DNA oligonucleotide
aaaaggcctctaaggatagcggagtcgaataacc

SEQ ID NO: 4951 - DNA, 30 bp, Artificial Sequence
  Single strand DNA oligonucleotide
aaagaattcctatgttacagcagccgcctc

SEQ ID NO: 4952 - DNA, 31 bp, Artificial Sequence
  Single strand DNA oligonucleotide
aaactcgagttcagaagcacagccattacag

SEQ ID NO: 4953 - DNA, 31 bp, Artificial Sequence
  Single strand DNA oligonucleotide
aaaggtaccatgacacatggacggatagatg

SEQ ID NO: 4954 - DNA, 31 bp, Artificial Sequence
  Single strand DNA oligonucleotide
tttggtaccgagatcgatgagcttcctgaac

SEQ ID NO: 4955 - DNA, 31 bp, Artificial Sequence
  Single strand DNA oligonucleotide
aaagaattccgcagacacgacagatataagg

SEQ ID NO: 4956 - DNA, 31 bp, Artificial Sequence
  Single strand DNA oligonucleotide
aaactcgagtgcactctaaacttgcagcatc

SEQ ID NO: 4957 - DNA, 37 bp, Artificial Sequence
  Single strand DNA oligonucleotide
aaaggtaccctcctactaccctactatactgtgctcc

SEQ ID NO: 4958 - DNA, 31 bp, Artificial Sequence
  Single strand DNA oligonucleotide
aaagaattccagcacaaacagccagtacttc

SEQ ID NO: 4959 - DNA, 31 bp, Artificial Sequence
  Single strand DNA oligonucleotide
aaactcgagtcagtttacacagagcagcacg

SEQ ID NO: 4960 - DNA, 31 bp, Artificial Sequence
  Single strand DNA oligonucleotide
aaagaattcaactggtgctccttaattcgtg

SEQ ID NO: 4961 - DNA, 31 bp, Artificial Sequence
  Single strand DNA oligonucleotide
aaagaattcaatgatgcgattgcagatacag

SEQ ID NO: 4962 - DNA, 31 bp, Artificial Sequence
  Single strand DNA oligonucleotide
aaactcgaggtcgattaaaccatgccttacg

SEQ ID NO: 4963 - DNA, 32 bp, Artificial Sequence
  Single strand DNA oligonucleotide
aaaggtaccggtatcctcctcctaacatgtgg

SEQ ID NO: 4964 - DNA, 31 bp, Artificial Sequence
  Single strand DNA oligonucleotide
aaagaattcctaacccatgaacaaacgggag

SEQ ID NO: 4965 - DNA, 32 bp, Artificial Sequence
  Single strand DNA oligonucleotide
aaaggtacctcacatagccatcaagttcacac

SEQ ID NO: 4966 - DNA, 34 bp, Artificial Sequence
  Single strand DNA oligonucleotide
aaagaattcctaatgacggattaacctaggcatc

SEQ ID NO: 4967 - DNA, 32 bp, Artificial Sequence
  Single strand DNA oligonucleotide
aaactcgagctaccaaagaagaaaggacgctc

SEQ ID NO: 4968 - DNA, 31 bp, Artificial Sequence
  Single strand DNA oligonucleotide
aatggtacctggtcaaggactctggactttc

SEQ ID NO: 4969 - DNA, 31 bp, Artificial Sequence
  Single strand DNA oligonucleotide
aaactcgagcccatagcatagcgtaagatgg

SEQ ID NO: 4970 - DNA, 31 bp, Artificial Sequence
  Single strand DNA oligonucleotide
aaactcgaggcacacaaagttcaacgaaatg

SEQ ID NO: 4971 - DNA, 31 bp, Artificial Sequence
  Single strand DNA oligonucleotide
aaactcgagcgttgtcgtcaatacacaatcc

SEQ ID NO: 4972 - DNA, 33 bp, Artificial Sequence
  Single strand DNA oligonucleotide
tttggtaccttacagggagtgcttccattatgc

SEQ ID NO: 4973 - DNA, 31 bp, Artificial Sequence
  Single strand DNA oligonucleotide
aaactcgaggaacagaacacctttctcccag

SEQ ID NO: 4974 - DNA, 31 bp, Artificial Sequence
  Single strand DNA oligonucleotide
aaactcgagaacaacgaacgactcttccatc

SEQ ID NO: 4975 - DNA, 34 bp, Artificial Sequence
  Single strand DNA oligonucleotide
aaagaattcctaacacagctgagggttacacttg

SEQ ID NO: 4976 - DNA, 31 bp, Artificial Sequence
  Single strand DNA oligonucleotide
aaaggtacccatggcagatgaaaccacatac

SEQ ID NO: 4977 - DNA, 32 bp, Artificial Sequence
  Single strand DNA oligonucleotide
aagggtacctcaagttcagtgtgcaagccgtt

SEQ ID NO: 4978 - DNA, 32 bp, Artificial Sequence
  Single strand DNA oligonucleotide
aaagaattctgatcgctatttgtttggaagag

SEQ ID NO: 4979 - DNA, 32 bp, Artificial Sequence
  Single strand DNA oligonucleotide
tttggtaccaagatatccgcgatgttcaaatg

SEQ ID NO: 4980 - DNA, 31 bp, Artificial Sequence
  Single strand DNA oligonucleotide
aaactcgaggggtacattggaaatggtcaag

SEQ ID NO: 4981 - DNA, 31 bp, Artificial Sequence
  Single strand DNA oligonucleotide
aaaggtacctccaacgtcgactagggtttag

SEQ ID NO: 4982 - DNA, 35 bp, Artificial Sequence
  Single strand DNA oligonucleotide
tttggtacctgaagttactaattgagcattcaacg

SEQ ID NO: 4983 - DNA, 33 bp, Artificial Sequence
  Single strand DNA oligonucleotide
aacggtacctcaggtgccacaagcctaaagatg

SEQ ID NO: 4984 - DNA, 28 bp, Artificial Sequence
  Single strand DNA oligonucleotide
aaaggtaccctatcccgtagcaacgcac

SEQ ID NO: 4985 - DNA, 34 bp, Artificial Sequence
  Single strand DNA oligonucleotide
tttgaattctcagattctacatcagccgtgcttg

SEQ ID NO: 4986 - DNA, 31 bp, Artificial Sequence
  Single strand DNA oligonucleotide
aaactcgagagggtaaccagagttgacgatg

SEQ ID NO: 4987 - DNA, 31 bp, Artificial Sequence
  Single strand DNA oligonucleotide
aaactcgagaatagcaatctcctgcacttgg

SEQ ID NO: 4988 - DNA, 31 bp, Artificial Sequence
  Single strand DNA oligonucleotide
aaagaattcatgtgttagtttcgggctcttg

SEQ ID NO: 4989 - DNA, 32 bp, Artificial Sequence
  Single strand DNA oligonucleotide
aaactcgaggcacggcattattgtgagtaaac

SEQ ID NO: 4990 - DNA, 31 bp, Artificial Sequence
  Single strand DNA oligonucleotide
aaaggtaccccagttcagttcagtccatacg

SEQ ID NO: 4991 - DNA, 31 bp, Artificial Sequence
  Single strand DNA oligonucleotide
aaagaattcagaggtccattaagctccaagc

SEQ ID NO: 4992 - DNA, 34 bp, Artificial Sequence
  Single strand DNA oligonucleotide
aaaggtaccctatttccatacaaaccaatccagc

SEQ ID NO: 4993 - DNA, 31 bp, Artificial Sequence
  Single strand DNA oligonucleotide
aaaggtaccactgattgacgtgattcctcag

SEQ ID NO: 4994 - DNA, 39 bp, Artificial Sequence
  Single strand DNA oligonucleotide
aaaaggcctctacagaatgcaattagaacagtctacaag

SEQ ID NO: 4995 - DNA, 29 bp, Artificial Sequence
  Single strand DNA oligonucleotide
aaaggtacccaggtgccaacaaagacaag

SEQ ID NO: 4996 - DNA, 31 bp, Artificial Sequence
  Single strand DNA oligonucleotide
ttaggtaccacttctgggcttattctccacc

SEQ ID NO: 4997 - DNA, 31 bp, Artificial Sequence
  Single strand DNA oligonucleotide
aaaggtacctgaagctggtgtaactcctacg

SEQ ID NO: 4998 - DNA, 35 bp, Artificial Sequence
  Single strand DNA oligonucleotide
aaagaattcctaaaatgccctaatatggtgtcctc

SEQ ID NO: 4999 - DNA, 34 bp, Artificial Sequence
  Single strand DNA oligonucleotide
tataggcctgacgagactaatgacaatcacacag

SEQ ID NO: 5000 - DNA, 34 bp, Artificial Sequence
  Single strand DNA oligonucleotide
aaaggatccctaccaaatccatccaaggtttatc

SEQ ID NO: 5001 - DNA, 31 bp, Artificial Sequence
  Single strand DNA oligonucleotide
aaactcgagcctaccagcatccaatatcagg

SEQ ID NO: 5002 - DNA, 31 bp, Artificial Sequence
  Single strand DNA oligonucleotide
aaaaggcctgttgcacttgctctgtcctatg

SEQ ID NO: 5003 - DNA, 33 bp, Artificial Sequence
  Single strand DNA oligonucleotide
aaaggtaccctaagtgacaagatcggtttcagc

SEQ ID NO: 5004 - DNA, 31 bp, Artificial Sequence
  Single strand DNA oligonucleotide
aaaaggcctcgccctactgtaagtttgatgc

SEQ ID NO: 5005 - DNA, 31 bp, Artificial Sequence
  Single strand DNA oligonucleotide
aaactcgagaggtataggcaggaagcacatc

SEQ ID NO: 5006 - DNA, 31 bp, Artificial Sequence
  Single strand DNA oligonucleotide
aaaggatccgttccatctccagcctaaagtg

SEQ ID NO: 5007 - DNA, 32 bp, Artificial Sequence
  Single strand DNA oligonucleotide
aaacccgggtgcaaatacaacatggacacaag

SEQ ID NO: 5008 - DNA, 34 bp, Artificial Sequence
  Single strand DNA oligonucleotide
atagaattctcaaggctttcatggcatactgctc

SEQ ID NO: 5009 - DNA, 31 bp, Artificial Sequence
  Single strand DNA oligonucleotide
aaaaggccttgcataaacaatgaagccaatg

SEQ ID NO: 5010 - DNA, 31 bp, Artificial Sequence
  Single strand DNA oligonucleotide
aaagagctcctccattctaggacagccacac

SEQ ID NO: 5011 - DNA, 33 bp, Artificial Sequence
  Single strand DNA oligonucleotide
aaagaattctcaaatcgatcacagcttcaggct

SEQ ID NO: 5012 - DNA, 31 bp, Artificial Sequence
  Single strand DNA oligonucleotide
aaactcgagcaaggattacgacttctccgtg

SEQ ID NO: 5013 - DNA, 32 bp, Artificial Sequence
  Single strand DNA oligonucleotide
aaagaattcctaatggccaccaaattgtatgc

SEQ ID NO: 5014 - DNA, 31 bp, Artificial Sequence
  Single strand DNA oligonucleotide
aaaggtaccattaaagctcgttgcctgtttg

SEQ ID NO: 5015 - DNA, 31 bp, Artificial Sequence
  Single strand DNA oligonucleotide
aaaaggcctctatttggcctccagtacaagc

SEQ ID NO: 5016 - DNA, 31 bp, Artificial Sequence
  Single strand DNA oligonucleotide
aaactcgagggtctgctacaactcgaaatgc

SEQ ID NO: 5017 - DNA, 31 bp, Artificial Sequence
  Single strand DNA oligonucleotide
aaaggtaccggcatcccaatacacaagtttc

SEQ ID NO: 5018 - DNA, 33 bp, Artificial Sequence
  Single strand DNA oligonucleotide
tttgaattcgaacatatcatctttcgcaagttg

SEQ ID NO: 5019 - DNA, 32 bp, Artificial Sequence
  Single strand DNA oligonucleotide
aaaggtacccaattcgttgctcttattcatcg

SEQ ID NO: 5020 - DNA, 34 bp, Artificial Sequence
  Single strand DNA oligonucleotide
aaaggtaccctatattgaacaggccttgctatcc

SEQ ID NO: 5021 - DNA, 31 bp, Artificial Sequence
  Single strand DNA oligonucleotide
aaaggatccatacaaagtgcaagggaactcg

SEQ ID NO: 5022 - DNA, 31 bp, Artificial Sequence
  Single strand DNA oligonucleotide
aaagaattctgaaagcgaaccttgcattatc

SEQ ID NO: 5023 - DNA, 31 bp, Artificial Sequence
  Single strand DNA oligonucleotide
aaactcgagaccctacaggcctacacaacag

SEQ ID NO: 5024 - DNA, 30 bp, Artificial Sequence
  Single strand DNA oligonucleotide
aaactcgagatctcactatctccggccaac

SEQ ID NO: 5025 - DNA, 31 bp, Artificial Sequence
  Single strand DNA oligonucleotide
aaactcgagtaccaatgttggctgacaaatg

SEQ ID NO: 5026 - DNA, 31 bp, Artificial Sequence
  Single strand DNA oligonucleotide
aaactcgagtcaaagcatcagataggacagc

SEQ ID NO: 5027 - DNA, 35 bp, Artificial Sequence
  Single strand DNA oligonucleotide
tttgaattctcacactgatcaagcctggagatctc

SEQ ID NO: 5028 - DNA, 30 bp, Artificial Sequence
  Single strand DNA oligonucleotide
aaagaattccatggcattgcaatttacagc

SEQ ID NO: 5029 - DNA, 33 bp, Artificial Sequence
  Single strand DNA oligonucleotide
aaaggtacccacagagatcatccaagacaattg

SEQ ID NO: 5030 - DNA, 31 bp, Artificial Sequence
  Single strand DNA oligonucleotide
aaaggtacccagaacagatcatcgtagcagc

SEQ ID NO: 5031 - DNA, 31 bp, Artificial Sequence
  Single strand DNA oligonucleotide
aaactcgagacagcatcaacagtaaagcacg

SEQ ID NO: 5032 - DNA, 32 bp, Artificial Sequence
  Single strand DNA oligonucleotide
aaagagctccgatcatgtagcaagagtgaagg

SEQ ID NO: 5033 - DNA, 33 bp, Artificial Sequence
  Single strand DNA oligonucleotide
aaaggtaccgaattttaacctgaggaatcatgc

SEQ ID NO: 5034 - DNA, 35 bp, Artificial Sequence
  Single strand DNA oligonucleotide
atagaattcgacaaatagggcatacattttccatc

SEQ ID NO: 5035 - DNA, 32 bp, Artificial Sequence
  Single strand DNA oligonucleotide
tttaggcctccaataaaacattcaggggattc

SEQ ID NO: 5036 - DNA, 34 bp, Artificial Sequence
  Single strand DNA oligonucleotide
ttagaattcatctttgcagtttgtgcatatatgg

SEQ ID NO: 5037 - DNA, 32 bp, Artificial Sequence
  Single strand DNA oligonucleotide
tttgaattcggtagcagcacatgtacactggt

SEQ ID NO: 5038 - DNA, 40 bp, Artificial Sequence
  Single strand DNA oligonucleotide
tttgaattctttaagattctggtaactaaactcaattgac

SEQ ID NO: 5039 - DNA, 31 bp, Artificial Sequence
  Single strand DNA oligonucleotide
aaagaattcggaacataggccatcatacgtc

SEQ ID NO: 5040 - DNA, 33 bp, Artificial Sequence
  Single strand DNA oligonucleotide
tttgaattcggatcaccatctcagagtacctca

SEQ ID NO: 5041 - DNA, 31 bp, Artificial Sequence
  Single strand DNA oligonucleotide
aaagaattcgtgtatgcagcagagagcagac

SEQ ID NO: 5042 - DNA, 37 bp, Artificial Sequence
  Single strand DNA oligonucleotide
tttggtaccttattgatgagattacttgtcttgctcc

SEQ ID NO: 5043 - DNA, 33 bp, Artificial Sequence
  Single strand DNA oligonucleotide
aaaggtaccgatgactccgtaatcagttacagc

SEQ ID NO: 5044 - DNA, 31 bp, Artificial Sequence
  Single strand DNA oligonucleotide
aaactcgagttcatttcaactccacagaacc

SEQ ID NO: 5045 - DNA, 31 bp, Artificial Sequence
  Single strand DNA oligonucleotide
aaactcgagttattccagcatccatcatcac

SEQ ID NO: 5046 - DNA, 32 bp, Artificial Sequence
  Single strand DNA oligonucleotide
aaagaattcgcatgacatactaggcagaaagg

SEQ ID NO: 5047 - DNA, 31 bp, Artificial Sequence
  Single strand DNA oligonucleotide
aaactcgagttcagagatactatccgccacc

SEQ ID NO: 5048 - DNA, 31 bp, Artificial Sequence
  Single strand DNA oligonucleotide
aaaggtaccttggtccaaacaaagcacatac

SEQ ID NO: 5049 - DNA, 31 bp, Artificial Sequence
  Single strand DNA oligonucleotide
aaagagctctaggttacagtgcccacaaatg

SEQ ID NO: 5050 - DNA, 31 bp, Artificial Sequence
  Single strand DNA oligonucleotide
aaagaattcatgttcaagaaacaacacgacc

SEQ ID NO: 5051 - DNA, 31 bp, Artificial Sequence
  Single strand DNA oligonucleotide
aaactcgagaaatgtgctacatcaaggcgac

SEQ ID NO: 5052 - DNA, 34 bp, Artificial Sequence
  Single strand DNA oligonucleotide
tttgaattctcagttgtccatgaccatgaatctg

SEQ ID NO: 5053 - DNA, 31 bp, Artificial Sequence
  Single strand DNA oligonucleotide
aaactcgaggcttattcaactggtgcaaatg

SEQ ID NO: 5054 - DNA, 31 bp, Artificial Sequence
  Single strand DNA oligonucleotide
aaactcgagaatggtacagcgatcctcaaac

SEQ ID NO: 5055 - DNA, 31 bp, Artificial Sequence
  Single strand DNA oligonucleotide
aaaggtaccctgttacaatctgcagagcagc

SEQ ID NO: 5056 - DNA, 31 bp, Artificial Sequence
  Single strand DNA oligonucleotide
aaactcgagatattcgtcacatggattgtgc

SEQ ID NO: 5057 - DNA, 31 bp, Artificial Sequence
  Single strand DNA oligonucleotide
aaactcgagttgaaatatccagcagcaacac

SEQ ID NO: 5058 - DNA, 31 bp, Artificial Sequence
  Single strand DNA oligonucleotide
aaaggtaccaattcatcccatcaagaagctc

SEQ ID NO: 5059 - DNA, 28 bp, Artificial Sequence
  Single strand DNA oligonucleotide
tttggtacctcggaaagcagagtcatgg

SEQ ID NO: 5060 - DNA, 31 bp, Artificial Sequence
  Single strand DNA oligonucleotide
aaactcgagtgctggctcaagcataataacc

SEQ ID NO: 5061 - DNA, 27 bp, Artificial Sequence
  Single strand DNA oligonucleotide
ttagaattcacagctcggtttcgcatc

SEQ ID NO: 5062 - DNA, 31 bp, Artificial Sequence
  Single strand DNA oligonucleotide
aaactcgagaatttacaggcaccaagctcac

SEQ ID NO: 5063 - DNA, 30 bp, Artificial Sequence
  Single strand DNA oligonucleotide
aaactcgagacatcaacaggctcagaatgg

SEQ ID NO: 5064 - DNA, 31 bp, Artificial Sequence
  Single strand DNA oligonucleotide
aaactcgagaaagactatccctggccaattc

SEQ ID NO: 5065 - DNA, 32 bp, Artificial Sequence
  Single strand DNA oligonucleotide
aacgaattctcaacagcttgccattcatctgg

SEQ ID NO: 5066 - DNA, 32 bp, Artificial Sequence
  Single strand DNA oligonucleotide
aaagaattcaccacagctagttcagccttacc

SEQ ID NO: 5067 - DNA, 31 bp, Artificial Sequence
  Single strand DNA oligonucleotide
aaaggtaccagcaaacaagagggtacagagc

SEQ ID NO: 5068 - DNA, 33 bp, Artificial Sequence
  Single strand DNA oligonucleotide
aaaggtaccagcctgatccgtatcaagaatatc

SEQ ID NO: 5069 - DNA, 31 bp, Artificial Sequence
  Single strand DNA oligonucleotide
aaagaattcaccttgattcattccaatcagc

SEQ ID NO: 5070 - DNA, 33 bp, Artificial Sequence
  Single strand DNA oligonucleotide
aaagaattcctgacataaacaaggcatagaagc

SEQ ID NO: 5071 - DNA, 33 bp, Artificial Sequence
  Single strand DNA oligonucleotide
aaactcgagctaaattacagaatcgccaggctc

SEQ ID NO: 5072 - DNA, 31 bp, Artificial Sequence
  Single strand DNA oligonucleotide
aaaaggcctaggccacaaatgcttataggtg

SEQ ID NO: 5073 - DNA, 32 bp, Artificial Sequence
  Single strand DNA oligonucleotide
aaaggtaccacatcttgaactttaggtcggtg

SEQ ID NO: 5074 - DNA, 31 bp, Artificial Sequence
  Single strand DNA oligonucleotide
ttaggtaccagctatgttctcttcctcctgc

SEQ ID NO: 5075 - DNA, 31 bp, Artificial Sequence
  Single strand DNA oligonucleotide
aaactcgagaattcattgtccagctaccgtc

SEQ ID NO: 5076 - DNA, 33 bp, Artificial Sequence
  Single strand DNA oligonucleotide
aaactcgagacaacaaataataccctgcacaag

SEQ ID NO: 5077 - DNA, 31 bp, Artificial Sequence
  Single strand DNA oligonucleotide
aaactcgagacatacaaggagcagcaggaac

SEQ ID NO: 5078 - DNA, 31 bp, Artificial Sequence
  Single strand DNA oligonucleotide
aaaggtaccaactgcagggacgaactttatc

SEQ ID NO: 5079 - DNA, 34 bp, Artificial Sequence
  Single strand DNA oligonucleotide
aaactcgagctagttaaggttgcgatggtgagtc

SEQ ID NO: 5080 - DNA, 31 bp, Artificial Sequence
  Single strand DNA oligonucleotide
aaaggtaccttctggtacgtaatcatggacg

SEQ ID NO: 5081 - DNA, 28 bp, Artificial Sequence
  Single strand DNA oligonucleotide
aaagaattccaacgtcgaggacaaggac

SEQ ID NO: 5082 - DNA, 31 bp, Artificial Sequence
  Single strand DNA oligonucleotide
aaaggtaccagaaactggttgagctggaaag

SEQ ID NO: 5083 - DNA, 32 bp, Artificial Sequence
  Single strand DNA oligonucleotide
aaaaggccttctttcagaaactacggtgatcc

SEQ ID NO: 5084 - DNA, 31 bp, Artificial Sequence
  Single strand DNA oligonucleotide
aaactcgagccaaagcaacgataatacctgg

SEQ ID NO: 5085 - DNA, 31 bp, Artificial Sequence
  Single strand DNA oligonucleotide
aaaggtacccgtgaatgagtatgacacatgg

SEQ ID NO: 5086 - DNA, 31 bp, Artificial Sequence
  Single strand DNA oligonucleotide
tttggtacctcagataattgggacgtgtttg

SEQ ID NO: 5087 - DNA, 31 bp, Artificial Sequence
  Single strand DNA oligonucleotide
aaagaattcatagttcatcgacaccgcagac

SEQ ID NO: 5088 - DNA, 31 bp, Artificial Sequence
  Single strand DNA oligonucleotide
aaactcgagcttctcaggcacaggcagatac

SEQ ID NO: 5089 - DNA, 31 bp, Artificial Sequence
  Single strand DNA oligonucleotide
aaagaattccagtgcaatatccagcacaaac

SEQ ID NO: 5090 - DNA, 31 bp, Artificial Sequence
  Single strand DNA oligonucleotide
aaactcgagagcccgtttaggattcaaactc

SEQ ID NO: 5091 - DNA, 31 bp, Artificial Sequence
  Single strand DNA oligonucleotide
aaagaattctatacatacgccaggacaccag

SEQ ID NO: 5092 - DNA, 31 bp, Artificial Sequence
  Single strand DNA oligonucleotide
aaagaattcaaagattggtttccgaatgatg

SEQ ID NO: 5093 - DNA, 31 bp, Artificial Sequence
  Single strand DNA oligonucleotide
aaactcgagtctagaagcatccatcacatgc

SEQ ID NO: 5094 - DNA, 31 bp, Artificial Sequence
  Single strand DNA oligonucleotide
aaaggtaccagccatcaagttcacacacaac

SEQ ID NO: 5095 - DNA, 34 bp, Artificial Sequence
  Single strand DNA oligonucleotide
aaagaattcctataatgcttcggacgaagatagc

SEQ ID NO: 5096 - DNA, 31 bp, Artificial Sequence
  Single strand DNA oligonucleotide
aaaggtaccaagaaagctcaattccatcagg

SEQ ID NO: 5097 - DNA, 31 bp, Artificial Sequence
  Single strand DNA oligonucleotide
aaactcgagaagcggatgtcacaactgtacc

SEQ ID NO: 5098 - DNA, 31 bp, Artificial Sequence
  Single strand DNA oligonucleotide
aaactcgagacaaatagaaagcctcgccaag

SEQ ID NO: 5099 - DNA, 31 bp, Artificial Sequence
  Single strand DNA oligonucleotide
aaactcgagtgtgtgattctgcttatcggac

SEQ ID NO: 5100 - DNA, 32 bp, Artificial Sequence
  Single strand DNA oligonucleotide
aaactcgagctaccatttcttccatcatttcg

SEQ ID NO: 5101 - DNA, 31 bp, Artificial Sequence
  Single strand DNA oligonucleotide
aaactcgagagtgaatgtgacactggctgac

SEQ ID NO: 5102 - DNA, 32 bp, Artificial Sequence
  Single strand DNA oligonucleotide
aaactcgagcctactgacaaaccgtgacacac

SEQ ID NO: 5103 - DNA, 36 bp, Artificial Sequence
  Single strand DNA oligonucleotide
aaagaattcctaagaaacatttccaatgacaaatcc

SEQ ID NO: 5104 - DNA, 33 bp, Artificial Sequence
  Single strand DNA oligonucleotide
aaactcgagcgattattattacagccaagctcc

SEQ ID NO: 5105 - DNA, 31 bp, Artificial Sequence
  Single strand DNA oligonucleotide
aaagaattctgccggatatgtacacaaagtg

SEQ ID NO: 5106 - DNA, 30 bp, Artificial Sequence
  Single strand DNA oligonucleotide
tttggtaccgccattgctattcccatcttc

SEQ ID NO: 5107 - DNA, 31 bp, Artificial Sequence
  Single strand DNA oligonucleotide
aaactcgagaaacacagctggagaattcctg

SEQ ID NO: 5108 - DNA, 30 bp, Artificial Sequence
  Single strand DNA oligonucleotide
tttggtaccctaaccgctagaggtgccaca

SEQ ID NO: 5109 - DNA, 31 bp, Artificial Sequence
  Single strand DNA oligonucleotide
aaactcgagttaccaaggcctaacttccgag

SEQ ID NO: 5110 - DNA, 31 bp, Artificial Sequence
  Single strand DNA oligonucleotide
aaagaattctgagaaacacaatcctctcgtg

SEQ ID NO: 5111 - DNA, 31 bp, Artificial Sequence
  Single strand DNA oligonucleotide
aaactcgagccaaacatgtatccgaggtagc

SEQ ID NO: 5112 - DNA, 31 bp, Artificial Sequence
  Single strand DNA oligonucleotide
aaagaattcccattacgcgcaaactattagg

SEQ ID NO: 5113 - DNA, 32 bp, Artificial Sequence
  Single strand DNA oligonucleotide
aaactcgaggaggaaagcaatcgtctaggttc

SEQ ID NO: 5114 - DNA, 31 bp, Artificial Sequence
  Single strand DNA oligonucleotide
aaaggtaccgtacaagaatccggaacctcac

SEQ ID NO: 5115 - DNA, 31 bp, Artificial Sequence
  Single strand DNA oligonucleotide
aaaggtaccaaacattccattcaggttcagg

SEQ ID NO: 5116 - DNA, 31 bp, Artificial Sequence
  Single strand DNA oligonucleotide
aaagaattcagaccacacaagaatgcctctc

SEQ ID NO: 5117 - DNA, 31 bp, Artificial Sequence
  Single strand DNA oligonucleotide
aacggtacctagaatcaccagcagcaagatg

SEQ ID NO: 5118 - DNA, 31 bp, Artificial Sequence
  Single strand DNA oligonucleotide
aaaggtacctcttcctgtacaacacatgacg

SEQ ID NO: 5119 - DNA, 31 bp, Artificial Sequence
  Single strand DNA oligonucleotide
aaagaattcgagcctaggagaacaacactgc

SEQ ID NO: 5120 - DNA, 31 bp, Artificial Sequence
  Single strand DNA oligonucleotide
aaactcgagaacatgaccagaaacacacgtc

SEQ ID NO: 5121 - DNA, 31 bp, Artificial Sequence
  Single strand DNA oligonucleotide
aaaggatcctatcttgcacgaggtgaacaac

SEQ ID NO: 5122 - DNA, 31 bp, Artificial Sequence
  Single strand DNA oligonucleotide
aaactcgagataggcaccaaccaaacagaac

SEQ ID NO: 5123 - DNA, 31 bp, Artificial Sequence
  Single strand DNA oligonucleotide
aaaaggcctatcatgctgaatggacatgaac

SEQ ID NO: 5124 - DNA, 32 bp, Artificial Sequence
  Single strand DNA oligonucleotide
aaaggtaccggcaattgatatttgaagcattg

SEQ ID NO: 5125 - DNA, 31 bp, Artificial Sequence
  Single strand DNA oligonucleotide
aaaaggccttccgtatatacaccactgcacg

SEQ ID NO: 5126 - DNA, 31 bp, Artificial Sequence
  Single strand DNA oligonucleotide
aaactcgaggggtgttcagaagacaagtgtg

SEQ ID NO: 5127 - DNA, 31 bp, Artificial Sequence
  Single strand DNA oligonucleotide
aaacccgggatacagaacatgccacaccttg

SEQ ID NO: 5128 - DNA, 31 bp, Artificial Sequence
  Single strand DNA oligonucleotide
aaaaggcctccacacaaacgtttaccatgac

SEQ ID NO: 5129 - DNA, 31 bp, Artificial Sequence
  Single strand DNA oligonucleotide
aaagagctcagctccctccattctaggacag

SEQ ID NO: 5130 - DNA, 31 bp, Artificial Sequence
  Single strand DNA oligonucleotide
aaactcgagtcagaatatcatcgtcgagcag

SEQ ID NO: 5131 - DNA, 31 bp, Artificial Sequence
  Single strand DNA oligonucleotide
aaaaggcctatagtggaaatggtggagcatc

SEQ ID NO: 5132 - DNA, 31 bp, Artificial Sequence
  Single strand DNA oligonucleotide
aaaaggcctgaaacgtgacaacattcattgg

SEQ ID NO: 5133 - DNA, 31 bp, Artificial Sequence
  Single strand DNA oligonucleotide
aaactcgagtcactgctttcaggtctgctac

SEQ ID NO: 5134 - DNA, 31 bp, Artificial Sequence
  Single strand DNA oligonucleotide
aaaggtacccgaatcaaactaaatggcatcc

SEQ ID NO: 5135 - DNA, 30 bp, Artificial Sequence
  Single strand DNA oligonucleotide
tttgaattctcgccactatccatttgaaca

SEQ ID NO: 5136 - DNA, 32 bp, Artificial Sequence
  Single strand DNA oligonucleotide
tttctcgagggttgcatgttacaacaatctcc

SEQ ID NO: 5137 - DNA, 26 bp, Artificial Sequence
  Single strand DNA oligonucleotide
aaaggtaccatgaggcggcaattcgt

SEQ ID NO: 5138 - DNA, 31 bp, Artificial Sequence
  Single strand DNA oligonucleotide
aaaggtaccagacacaaagcatggttcatcc

SEQ ID NO: 5139 - DNA, 31 bp, Artificial Sequence
  Single strand DNA oligonucleotide
aaaggatccagccaaagcagggatttaacac

SEQ ID NO: 5140 - DNA, 32 bp, Artificial Sequence
  Single strand DNA oligonucleotide
aaagaattccaacattaatttccacatcggac

SEQ ID NO: 5141 - DNA, 31 bp, Artificial Sequence
  Single strand DNA oligonucleotide
aaagaattccagttgaaacttgaaagcgaac

SEQ ID NO: 5142 - DNA, 31 bp, Artificial Sequence
  Single strand DNA oligonucleotide
aaactcgagtatctttgccgacaccctacag

SEQ ID NO: 5143 - DNA, 31 bp, Artificial Sequence
  Single strand DNA oligonucleotide
aaactcgagccagtgtacgattacagggagg

SEQ ID NO: 5144 - DNA, 31 bp, Artificial Sequence
  Single strand DNA oligonucleotide
aaactcgaggttcttccaggtaaagggcttc

SEQ ID NO: 5145 - DNA, 31 bp, Artificial Sequence
  Single strand DNA oligonucleotide
aaaggtacctcccattccaagggatctaaac

SEQ ID NO: 5146 - DNA, 33 bp, Artificial Sequence
  Single strand DNA oligonucleotide
aaagaattccatcagattagaaacatggcattg

SEQ ID NO: 5147 - DNA, 31 bp, Artificial Sequence
  Single strand DNA oligonucleotide
aaaggtaccaaactcctacacctgcctttcc

SEQ ID NO: 5148 - DNA, 31 bp, Artificial Sequence
  Single strand DNA oligonucleotide
aaactcgagagcttggaacagtgaagaatcg

SEQ ID NO: 5149 - DNA, 31 bp, Artificial Sequence
  Single strand DNA oligonucleotide
aaaggtaccgctctgcagggtctcaatctac

SEQ ID NO: 5150 - DNA, 31 bp, Artificial Sequence
  Single strand DNA oligonucleotide
aaagagctccagggctatacatcctgcattc

SEQ ID NO: 5151 - DNA, 36 bp, Artificial Sequence
  Single strand DNA oligonucleotide
aaaggtacccaattcttattaatgatgaaaagccag

SEQ ID NO: 5152 - DNA, 30 bp, Artificial Sequence
  Single strand DNA oligonucleotide
tttgaattcagaaaccacaatcatcgatgg

SEQ ID NO: 5153 - DNA, 36 bp, Artificial Sequence
  Single strand DNA oligonucleotide
tatgaattctgattgacaaatagggcatacattttc

SEQ ID NO: 5154 - DNA, 41 bp, Artificial Sequence
  Single strand DNA oligonucleotide
aatgaattccaacaaattttaagattctggtaactaaactc

SEQ ID NO: 5155 - DNA, 30 bp, Artificial Sequence
  Single strand DNA oligonucleotide
tttgaattccaaggctcagttatcctccca

SEQ ID NO: 5156 - DNA, 1321 bp, Artificial Sequence
  rbcS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 5157 - DNA, 1358 bp, Artificial Sequence
  Ubi 1 Promoter
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 5158 - DNA, 781 bp, Artificial Sequence
  35S pJJ Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 5159 - DNA, 877 bp, Artificial Sequence
  35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc
